(12) United States Patent
Weissman et al.

(10) Patent No.: US 11,660,332 B2
(45) Date of Patent: May 30, 2023

(54) NUCLEOSIDE-MODIFIED MRNA-LIPID NANOPARTICLE LINEAGE VACCINE FOR HEPATITIS C VIRUS

(71) Applicants: The Trustees of the University of Pennsylvania, Philadelphia, PA (US); THE JOHNS HOPKINS UNIVERSITY, Baltimore, MD (US); VANDERBILT UNIVERSITY, Nashville, TN (US)

(72) Inventors: Drew Weissman, Wynnewood, PA (US); George M. Shaw, Wallingford, PA (US); Justin R. Bailey, Timonium, MD (US); Stuart C. Ray, Lutherville, MD (US); James Crowe, Jr., Nashville, TN (US); Andrew Flyak, Pasadena, CA (US)

(73) Assignees: The Trustees of the University of Pennsylvania, Philadelphia, PA (US); The Johns Hopkins University, Baltimore, MD (US); Vanderbilt Univeisily, Nashville, TN (US)

(*) Notice: Subject to any disclaimer, the term of this patent is extended or adjusted under 35 U.S.C. 154(b) by 0 days.

(21) Appl. No.: 16/608,392

(22) PCT Filed: Apr. 27, 2018

(86) PCT No.: PCT/US2018/029686
§ 371 (c)(1),
(2) Date: Oct. 25, 2019

(87) PCT Pub. No.: WO2018/200892
PCT Pub. Date: Nov. 1, 2018

(65) Prior Publication Data
US 2020/0222528 A1    Jul. 16, 2020

Related U.S. Application Data

(60) Provisional application No. 62/490,828, filed on Apr. 27, 2017.

(51) Int. Cl.
C07H 21/04 (2006.01)
A61K 39/12 (2006.01)
(Continued)

(52) U.S. Cl.
CPC .............. *A61K 39/12* (2013.01); *A61K 9/127* (2013.01); *A61K 39/29* (2013.01); *A61K 39/39* (2013.01);
(Continued)

(58) Field of Classification Search
None
See application file for complete search history.

(56) References Cited

U.S. PATENT DOCUMENTS 8,278,036 B2    10/2012  Kariko
2003/0153081 A1  8/2003  Tagawa
(Continued)

FOREIGN PATENT DOCUMENTS

WO    2005004910    1/2005
WO    2007024708    3/2007
(Continued)

OTHER PUBLICATIONS

"Hepacivirus C", UniprotKB, (Mar. 21, 2012), Database accession No. H2FJ05_9HEPC, XP055535308.
(Continued)

*Primary Examiner* — M Franco G Salvoza
(74) *Attorney, Agent, or Firm* — Riverside Law LLP

(57) ABSTRACT

The present invention relates to compositions and methods for inducing an adaptive immune response against Hepatitis C virus (HCV) in a subject. In some embodiments, the
(Continued)

present invention provides a composition comprising a nucleoside-modified nucleic acid molecule encoding a HCV antigen, adjuvant, or a combination thereof. For example, in some embodiments, the composition comprises a vaccine comprising a nucleoside-modified nucleic acid molecule encoding a HCV antigen, adjuvant, or a combination thereof.

8 Claims, 17 Drawing Sheets

Specification includes a Sequence Listing.

(51) Int. Cl.
*A61K 39/39* (2006.01)
*A61P 31/14* (2006.01)
*A61K 9/127* (2006.01)
*A61K 39/29* (2006.01)
*A61K 9/00* (2006.01)
*A61K 39/00* (2006.01)

(52) U.S. Cl.
CPC ............ *A61P 31/14* (2018.01); *A61K 9/0019* (2013.01); *A61K 2039/5258* (2013.01); *A61K 2039/53* (2013.01); *A61K 2039/55555* (2013.01)

(56) References Cited

U.S. PATENT DOCUMENTS

| | | |
|---|---|---|
| 2005/0032730 A1 | 2/2005 | Von |
| 2005/0250723 A1 | 11/2005 | Hoerr |
| 2006/0188490 A1 | 8/2006 | Hoerr |
| 2008/0025944 A1 | 1/2008 | Hoerr |
| 2009/0324584 A1 | 12/2009 | Hoerr |
| 2010/0189729 A1 | 7/2010 | Hoerr |
| 2010/0203076 A1 | 8/2010 | Fotin-Mleczek |
| 2011/0150921 A1 | 6/2011 | Roingeard |
| 2011/0250225 A1 | 10/2011 | Fotin-Mleczek |
| 2011/0256175 A1 | 10/2011 | Hope |
| 2011/0300205 A1* | 12/2011 | Geall ................ A61K 39/00 424/450 |
| 2012/0021043 A1 | 1/2012 | Kramps |
| 2012/0276209 A1 | 11/2012 | Cullis |
| 2012/0288510 A1 | 11/2012 | Ambrosino |
| 2013/0129754 A1 | 5/2013 | Thess |
| 2013/0259879 A1 | 10/2013 | Baumhof |
| 2013/0261172 A1 | 10/2013 | Kariko |
| 2013/0266640 A1 | 10/2013 | De Fougerolles |
| 2013/0280283 A1 | 10/2013 | Lorenz |
| 2014/0134175 A1 | 5/2014 | Ambrosino |
| 2015/0037326 A1 | 2/2015 | Butler-Ransohoff |
| 2015/0093413 A1 | 4/2015 | Thess |
| 2015/0118183 A1 | 4/2015 | Baumhof |
| 2015/0118264 A1 | 4/2015 | Baumhof |
| 2015/0165006 A1 | 6/2015 | Thess |
| 2015/0184195 A1 | 7/2015 | Thess |
| 2015/0218554 A1 | 8/2015 | Thess |
| 2015/0376115 A1 | 12/2015 | Ansell |
| 2016/0130345 A1 | 5/2016 | Fotin-Mleczek |
| 2016/0166668 A1 | 6/2016 | Kallen |
| 2016/0166678 A1 | 6/2016 | Kallen |
| 2016/0166710 A1 | 6/2016 | Baumhof |
| 2016/0166711 A1 | 6/2016 | Schnee |
| 2016/0168207 A1 | 6/2016 | Kramps |
| 2016/0235864 A1 | 8/2016 | Schlake |
| 2016/0304883 A1 | 10/2016 | Grund |
| 2016/0331828 A1* | 11/2016 | Ciaramella .......... A61K 39/145 |
| 2016/0361411 A1 | 12/2016 | Gindy |
| 2016/0376224 A1 | 12/2016 | Du |
| 2017/0029847 A1 | 2/2017 | Thess |
| 2017/0119904 A1 | 5/2017 | Ansell |
| 2017/0157268 A1 | 6/2017 | Ansell |
| 2017/0252430 A1 | 9/2017 | Fotin-Mleczek |
| 2017/0283367 A1 | 10/2017 | Ansell |
| 2017/0326225 A1 | 11/2017 | Rauch |
| 2018/0044687 A1 | 2/2018 | Thess |
| 2018/0125952 A1 | 5/2018 | Fotin-Mleczek |
| 2018/0126003 A1 | 5/2018 | Hoerr |
| 2018/0148727 A1 | 5/2018 | Grund |
| 2018/0214537 A1 | 8/2018 | Mutzke |
| 2018/0237786 A1 | 8/2018 | Schlake |
| 2018/0296663 A1 | 10/2018 | Hipp |
| 2018/0312545 A1 | 11/2018 | Baumhof |
| 2019/0270697 A1 | 9/2019 | Ansell |
| 2019/0274968 A1 | 9/2019 | Weissman |

FOREIGN PATENT DOCUMENTS

| | | | |
|---|---|---|---|
| WO | 2013143555 | 10/2013 | |
| WO | 2014160243 | 10/2014 | |
| WO | 2014160284 | 10/2014 | |
| WO | 2015164674 | 10/2015 | |
| WO | WO-2016176330 A1 * | 11/2016 | ............ A61K 39/12 |
| WO | 2017006182 | 1/2017 | |
| WO | 2017021546 | 2/2017 | |
| WO | 2017140905 | 8/2017 | |

OTHER PUBLICATIONS

Anderson et al., 2010, "Incorporation of pseudouridine into mRNA enhances translation by diminishing PKR activation." Nucleic Acids Res 38:5884-5892.

Brito et al: 'Self-Amplifying mRNA Vaccines,' Adv Genet, 2015;89:179-233.

D.N. Nguyen et al: "Lipid-derived nanoparticles for immunostimulatory RNA adjuvant delivery", Proceedings of the National Academy of Sciences of the United States of America, vol. 109, No. 14, Apr. 3, 2012 (Apr. 3, 2012), pp. E797-E803.

Hekele et al., "Rapidly produced SAM® vaccine against H7N9 influenza is immunogenic in mice," Emerging Microbes and Infections 2:e52, 2013 (7 pages).

Hsu et al., "Hepatitis C virus glycoproteins mediate pH-dependent cell entry of pseudotyped retroviral particles," Proc Natl Acad Sci U S A, Jun. 10, 2003;100(12):7271-6.

Karikó et al., 2008, "Incorporation of Pseudouridine into mRNA Yields Superior Nonimmunogenic Vector With Increased Translational and Biological Stability." Mol Ther 16:1833-1840.

Krol et al., "Anti-Hepatitis C Virus Activity of Uridine Derivatives of 2-Deoxy Sugars," Molecules 2018, 23(7), 1547.

Leung et al., 2012, "Lipid Nanoparticles Containing siRNA Synthesized by Microfluidic Mixing Exhibit an Electron-Dense Nanostructured Core." J Phys Chem C Nanomater Interfaces, 116(34): 18440-18450.

Liu et al., "Spontaneous clearance of primary acute hepatitis C virus infection correlated with high initial viral RNA level and rapid HVR1 evolution." Hepatology, Jun. 2012;55(6):1684-91.

Pardi et al., "Expression kinetics of nucleoside-modified mRNA delivered in lipid nanoparticles to mice by various routes," Journal of Controlled Release vol. 217, Nov. 10, 2015, pp. 345-351.

Petsch et al., "Protective efficacy of in vitro synthesized, specific mRNA vaccines against influenza A virus infection," Nature Biotechnology 30:1210-1216, 2012.

Schnee et al., "An mRNA Vaccine Encoding Rabies Virus Glycoprotein Induces Protection against Lethal Infection in Mice and Correlates of Protection in Adult and Newborn Pigs," PLoS Negl. Trop. Dis. 10(6):e0004746, 2016, 20 pages.

Szebeni et al., "Activation of complement by therapeutic liposomes and other lipid excipient-based therapeutic products: Prediction and prevention," Advanced Drug Delivery Reviews 63:1020-1030, 2011.

Torrecilla, J et al., "Lipid Nanoparticles as Carriers for RNAi against Viral infections: Current Status and Future Perspectives.", BioMed Research International., (Aug. 12, 2014), vol. 2014, No. 2014, pp. 1-18, XP055326069.

Xue et al., "Lipid-Based Nanocarriers for RNA Delivery," Current Pharmaceutical Design 21:3140-3147, 2015.

(56) References Cited

OTHER PUBLICATIONS

Zeisel et al.: 'Hepatitis C virus entry into hepatocytes: Molecular mechanisms and targets for antiviral therapies.' J Hepatol, Mar. 2011;54(3):566-76.

\* cited by examiner

Figure 1A

Figure 2A

NUCLEOSIDE-MODIFIED MRNA-LIPID NANOPARTICLE LINEAGE VACCINE FOR HEPATITIS C VIRUS

CROSS-REFERENCE TO RELATED APPLICATIONS

This application is a U.S. national phase application filed under 35 U.S.C. § 371 claiming priority to International Patent Application No. PCT/US2018/029686, filed Apr. 27, 2018, which is entitled to priority under 35 U.S.C. § 119(e) to U.S. Provisional Patent Application No. 62/490,828, filed Apr. 27, 2017, the contents of each of which are incorporated by reference herein in their entireties.

STATEMENT REGARDING FEDERALLY SPONSORED RESEARCH OR DEVELOPMENT

This invention was made with government support under NIH U19 AI088791, K08 AI102761, P30 A1094189, RO1-A1050484, and RO1-A1084860 awarded by the National Institutes of Health. The government has certain rights in the invention.

BACKGROUND OF THE INVENTION

Hepatitis C virus (HCV) infection carries a significant clinical burden in the U.S. alone, affecting over 160 million people worldwide and 4.6 million Americans, and is the leading cause of liver transplantation in North America. Untreated chronic HCV infection can result in cirrhosis, portal hypertension, and hepatocellular carcinoma. Previous treatments, including interferon-based treatments, had low rates of success and significant adverse effects. While the advent of new generation oral antiviral therapy has led to major improvements in efficacy and tolerability, preventing the disease remains an important strategy for managing the burden of this disease. For these reasons, there is an urgent need to develop a prophylactic HCV vaccine, and to determine if therapeutic vaccines can aid in the treatment of chronically infected patients.

The current standard of care therapy includes treatment with a combination of direct acting antivirals (DAAs), pharmacologic inhibitors of the viral NS3/4A protease, NSSA, or NSSB polymerase, with overall treatment efficacy greater than 90%. Despite this progress, viral resistance to these treatments has been observed clinically, and has been associated with treatment failure. Most infected individuals throughout the world are unaware of their infection status and may continue to infect others, and treatment does not prevent reinfection after cure. The high costs of these new therapies and the large numbers of HCV-infected individuals means the health-care system, even in developed countries, cannot afford to treat all patients. This limitation is even more pronounced in developing countries. Therefore, development of a vaccine to prevent acute or chronic HCV infection is essential.

Thus, there is a need in the art for improved hepatitis C virus (HCV) vaccines. The present invention addresses this need.

BRIEF DESCRIPTION OF THE DRAWINGS

The following detailed description of embodiments of the invention will be better understood when read in conjunction with the appended drawings. It should be understood that the invention is not limited to the precise arrangements and instrumentalities of the embodiments shown in the drawings.

Figure 1A:
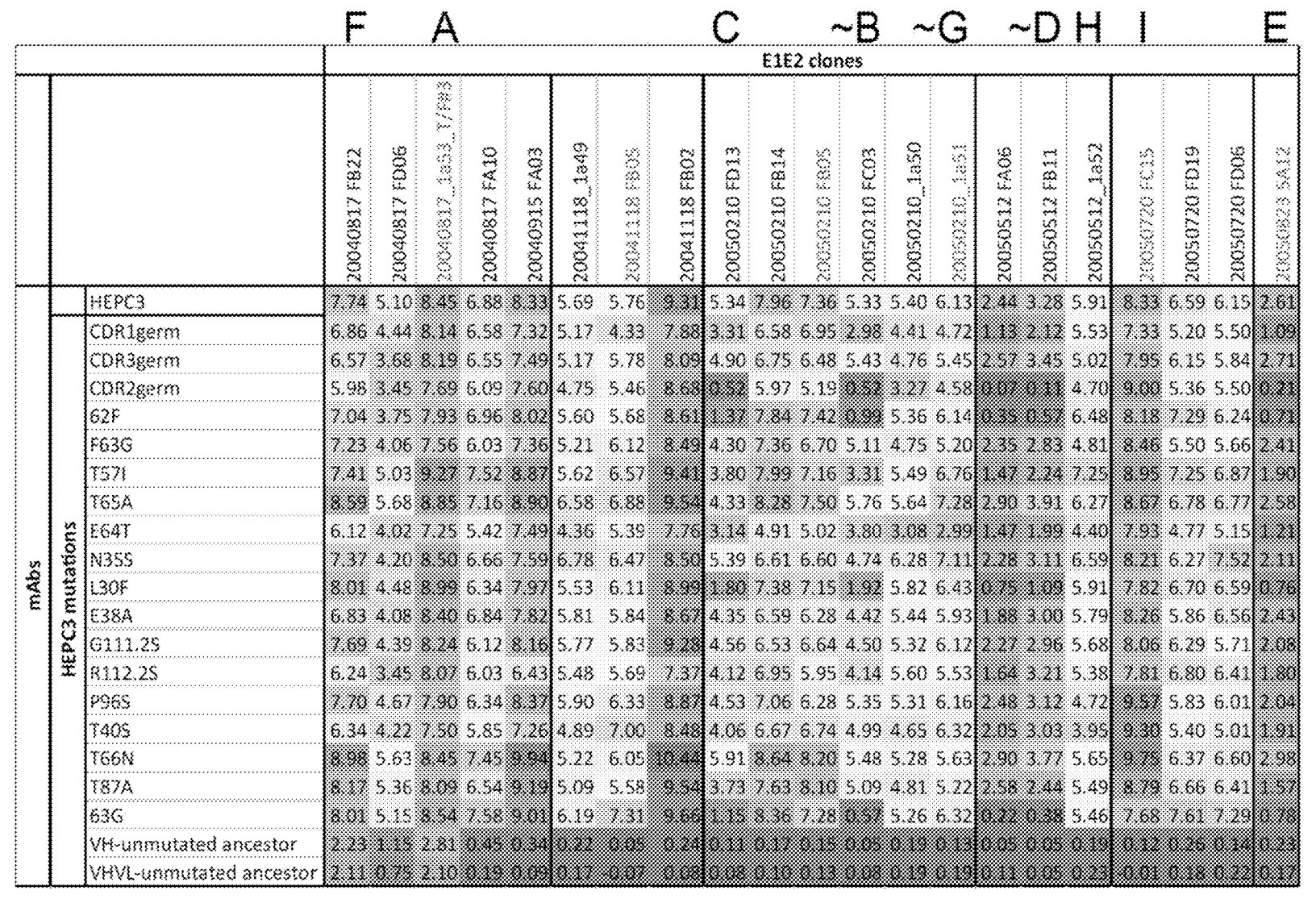

FIG. 1, comprising FIG. 1A and FIG. 1B, depicts the results of example experiments. FIG. 1A depicts the results of experiments analyzing the mutational lineage of HCV E1E2 over time from infection and the ability of these proteins to bind HEPC3 and mutant antibodies. Area under the curve (AUC) of binding of serial dilutions of the indicated mAbs to autologous E1E2 proteins are shown. FIG. 1B depicts a dendrogram depicting phenotypic relationships between E1E2 clones, determined by hierarchy of binding of mAbs to each E1E2 clone. Rank-binding of all mAbs to each E1E2 clone were compared in pairwise fashion by spearman correlation (r), and these r values were used to cluster related E1E2 clones. Approximately Unbiased (AU) values are provided indicating the strength of a cluster, with values >95 considered highly significant. Clones are representative of each phenotypic cluster.

FIG. 2, comprising FIG. 2A and FIG. 2B, depicts the results of additional experiments. FIG. 2A depicts the results of additional experiments analyzing the mutational lineage of HCV E1E2 over time from infection and the ability of these proteins to bind HEPC3 and mutant antibodies. Area under the curve (AUC) of binding of serial dilutions of the indicated mAbs to autologous E1E2 proteins are shown. FIG. 2B depicts a dendrogram depicting phenotypic relationships between E1E2 clones, determined by hierarchy of binding of mAbs to each E1E2 clone. Rank-binding of all mAbs to each E1E2 clone were compared in pairwise fashion by spearman correlation (r), and these r values were used to cluster related E1E2 clones. Approximately Unbiased (AU) values are provided indicating the strength of a cluster, with values >95 considered highly significant. Clones are representative of each phenotypic cluster.

DETAILED DESCRIPTION

Figure 1B:
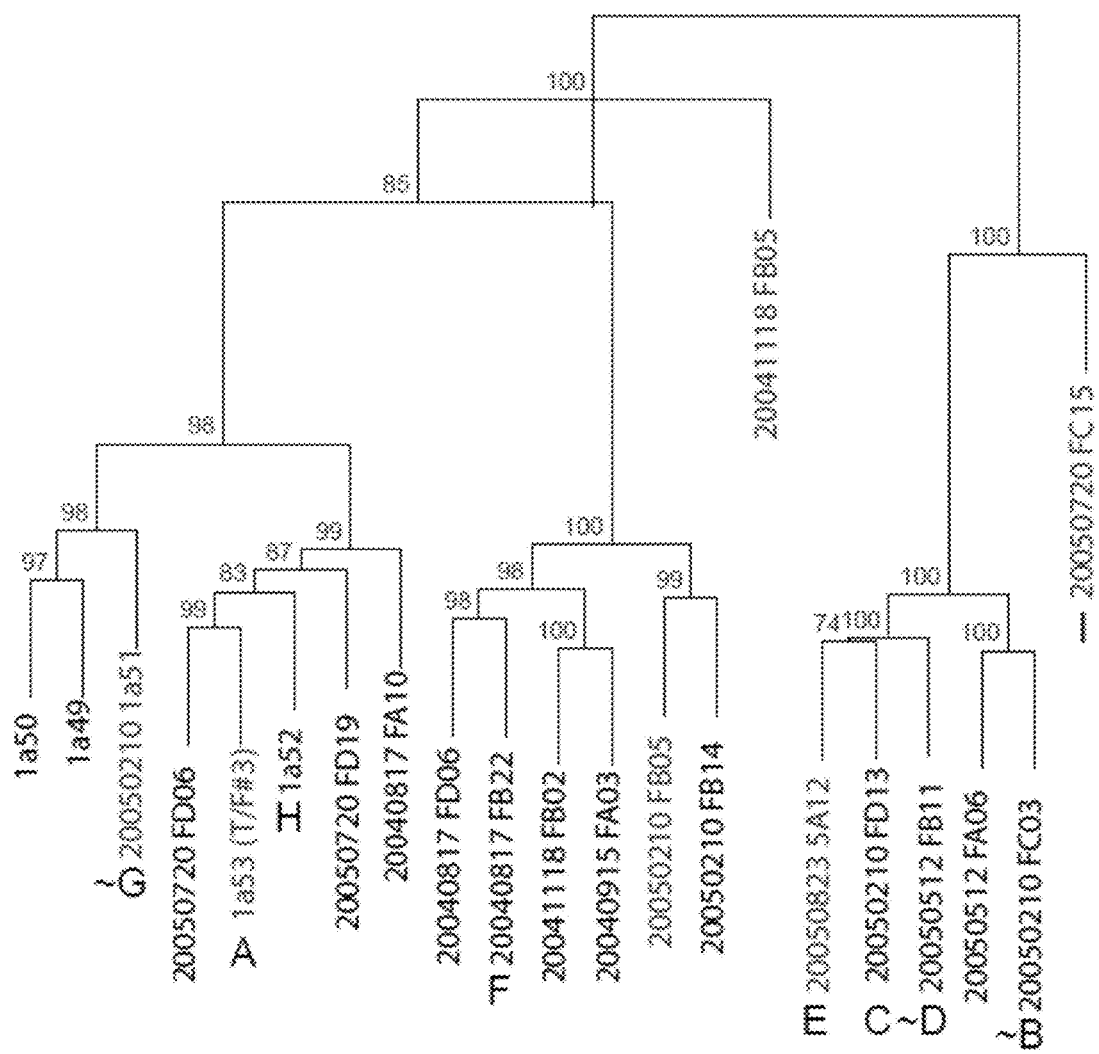

The present invention relates to compositions and methods for inducing an immune response against hepatitis C virus (HCV) in a subject. In some embodiments, the invention provides a composition comprising at least one nucleoside-modified RNA encoding at least one HCV antigen. For example, in one embodiment, the composition is a vaccine comprising at least one nucleoside-modified RNA encoding at least one HCV antigen, where the vaccine induces an immune response in the subject to the at least one HCV antigen, and therefore induces an immune response in the subject to Hepatitis C virus or pathology associated with Hepatitis C virus. In some embodiments, the at least one nucleoside-modified RNA encodes core protein of HCV, envelope E1 protein of HCV, envelope E2 protein of HCV, or a combination thereof. In one embodiment, the nucleoside-modified RNA encodes a sequential lineage of envelope proteins encoded in the mRNA as a single protein comprising the core and envelope 1 and 2 proteins (C-E1-E2). In some embodiments, the at least one nucleoside-modified RNA is encapsulated in a lipid nanoparticle (LNP).

Definitions

Unless defined otherwise, all technical and scientific terms used herein have the same meaning as commonly understood by one of ordinary skill in the art to which this invention belongs.

As used herein, each of the following terms has the meaning associated with it in this section.

The articles "a" and "an" are used herein to refer to one or to more than one (i.e., to at least one) of the grammatical object of the article. By way of example, "an element" means one element or more than one element.

"About" as used herein when referring to a measurable value such as an amount, a temporal duration, and the like, is meant to encompass variations of ±20%, ±10%, ±5%, ±1%, or ±0.1% from the specified value, as such variations are appropriate to perform the disclosed methods.

The term "antibody," as used herein, refers to an immunoglobulin molecule, which specifically binds with an antigen. Antibodies can be intact immunoglobulins derived from natural sources or from recombinant sources and can be immunoreactive portions of intact immunoglobulins. Antibodies are typically tetramers of immunoglobulin molecules. The antibodies in the present invention may exist in a variety of forms including, for example, polyclonal antibodies, monoclonal antibodies, Fv, Fab and F(ab)2, as well as single chain antibodies and humanized antibodies (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426).

The term "antibody fragment" refers to a portion of an intact antibody and refers to the antigenic determining variable regions of an intact antibody. Examples of antibody fragments include, but are not limited to, Fab, Fab', F(ab')2, and Fv fragments, linear antibodies, scFv antibodies, and multispecific antibodies formed from antibody fragments.

An "antibody heavy chain," as used herein, refers to the larger of the two types of polypeptide chains present in all antibody molecules in their naturally occurring conformations.

An "antibody light chain," as used herein, refers to the smaller of the two types of polypeptide chains present in all antibody molecules in their naturally occurring conformations. κ and λ light chains refer to the two major antibody light chain isotypes.

By the term "synthetic antibody" as used herein, is meant an antibody, which is generated using recombinant DNA technology. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using synthetic DNA or amino acid sequence technology which is available and well known in the art. The term should also be construed to mean an antibody, which has been generated by the synthesis of an RNA molecule encoding the antibody. The RNA molecule expresses an antibody protein, or an amino acid sequence specifying the antibody, wherein the RNA has been obtained by transcribing DNA (synthetic or cloned), synthesizing the RNA, or other technology, which is available and well known in the art.

The term "antigen" or "Ag" as used herein is defined as a molecule that provokes an adaptive immune response. This immune response may involve either antibody production, or the activation of specific immunogenically-competent cells, or both. The skilled artisan will understand that any macromolecule, including virtually all proteins or peptides, can serve as an antigen. Furthermore, antigens can be derived from recombinant or genomic DNA or RNA. A skilled artisan will understand that any DNA or RNA, which comprises a nucleotide sequence or a partial nucleotide sequence encoding a protein that elicits an adaptive immune response therefore encodes an "antigen" as that term is used herein. Furthermore, one skilled in the art will understand that an antigen need not be encoded solely by a full-length nucleotide sequence of a gene. It is readily apparent that the present invention includes, but is not limited to, the use of partial nucleotide sequences of more than one gene and that these nucleotide sequences are arranged in various combinations to elicit the desired immune response. Moreover, a skilled artisan will understand that an antigen need not be encoded by a "gene" at all. It is readily apparent that an antigen can be generated synthesized or can be derived from a biological sample. Such a biological sample can include, but is not limited to a tissue sample, a tumor sample, a cell or a biological fluid.

The term "adjuvant" as used herein is defined as any molecule to enhance an antigen-specific adaptive immune response.

A "disease" is a state of health of an animal wherein the animal cannot maintain homeostasis, and wherein if the disease is not ameliorated then the animal's health continues to deteriorate. In contrast, a "disorder" in an animal is a state of health in which the animal is able to maintain homeostasis, but in which the animal's state of health is less favorable than it would be in the absence of the disorder. Left untreated, a disorder does not necessarily cause a further decrease in the animal's state of health.

An "effective amount" as used herein, means an amount which provides a therapeutic or prophylactic benefit.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

"Expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) RNA, and viruses (e.g., lentiviruses, retroviruses, adenoviruses, and adeno-associated viruses) that incorporate the recombinant polynucleotide.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared X 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

"Immunogen" refers to any substance introduced into the body in order to generate an immune response. That substance can a physical molecule, such as a protein, or can be encoded by a vector, such as DNA, mRNA, or a virus.

"Immune response," as the term is used herein, means a process involving the activation and/or induction of an effector function in, by way of non-limiting examples, a T cell, B cell, natural killer (NK) cell, and/or an antigen-presenting cell (APC). Thus, an immune response, as would be understood by the skilled artisan, includes, but is not limited to, any detectable antigen-specific activation and/or induction of a helper T cell or cytotoxic T cell activity or response, production of antibodies, antigen presenting cell activity or infiltration, macrophage activity or infiltration, neutrophil activity or infiltration, and the like.

"Isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleosides (nucleobase bound to ribose or deoxyribose sugar via N-glycosidic linkage) are used. "A" refers to adenosine, "C" refers to cytidine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

By the term "modulating," as used herein, is meant mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, such as, a human.

Unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns. In addition, the nucleotide sequence may contain modified nucleosides that are capable of being translated by translational machinery in a cell. Exemplary modified nucleosides are described elsewhere herein. For example, an mRNA where some or all of the uridines have been replaced with pseudouridine, 1-methyl psuedouridine, or another modified nucleoside, such as those described elsewhere herein. In some embodiments, the nucleotide sequence may contain a sequence where some or all cytodines are replaced with methylated cytidine, or another modified nucleoside, such as those described elsewhere herein.

The term "operably linked" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA or RNA sequences are contiguous and, where necessary to join two protein coding regions, in the same reading frame.

The terms "patient," "subject," "individual," and the like are used interchangeably herein, and refer to any animal, or cells thereof whether in vitro or in situ, amenable to the methods described herein. In some non-limiting embodiments, the patient, subject or individual is a human.

The term "polynucleotide" as used herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCRTM, and the like, and by synthetic means.

In some instances, the polynucleotide or nucleic acid of the invention is a "nucleoside-modified nucleic acid," which refers to a nucleic acid comprising at least one modified nucleoside. A "modified nucleoside" refers to a nucleoside with a modification. For example, over one hundred different nucleoside modifications have been identified in RNA (Rozenski, et al., 1999, The RNA Modification Database: 1999 update. Nucl Acids Res 27: 196-197).

In some embodiments, "pseudouridine" refers to $m^1acp^3\Psi$ (1-methyl-3-(3-amino-3-carboxypropyl) pseudouridine). In another embodiment, the term refers to $m^1\Psi$ (1-methylpseudouridine). In another embodiment, the term refers to $\Psi m$ (2'-O-methylpseudouridine. In another embodiment, the term refers to $m^5D$ (5-methyldihydrouridine). In another embodiment, the term refers to $m^3\Psi$ (3-methylpseudouridine). In another embodiment, the term refers to a pseudouridine moiety that is not further modified. In another embodiment, the term refers to a monophosphate, diphosphate, or triphosphate of any of the above pseudouridines. In another embodiment, the term refers to any other pseudouridine known in the art. Each possibility represents a separate embodiment of the present invention.

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "promoter" as used herein is defined as a DNA sequence recognized by the synthetic machinery of the cell, or introduced synthetic machinery, required to initiate the specific transcription of a polynucleotide sequence. By way of one non-limiting example, a promoter that is recognized by bacteriophage RNA polymerase and is used to generate the mRNA by in vitro transcription.

By the term "specifically binds," as used herein with respect to an antibody, is meant an antibody which recognizes a specific antigen, but does not substantially recognize or bind other molecules in a sample. For example, an antibody that specifically binds to an antigen from one species may also bind to that antigen from one or more other species. But, such cross-species reactivity does not itself alter the classification of an antibody as specific. In another example, an antibody that specifically binds to an antigen may also bind to different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A", the presence of a molecule containing epitope A (or free, unlabeled A), in a reaction containing labeled "A" and the antibody, will reduce the amount of labeled A bound to the antibody.

The term "therapeutic" as used herein means a treatment and/or prophylaxis. A therapeutic effect is obtained by suppression, diminution, remission, prevention, or eradication of at least one sign or symptom of a disease or disorder.

The term "therapeutically effective amount" refers to the amount of the subject compound that will elicit the biological or medical response of a tissue, system, or subject that is being sought by the researcher, veterinarian, medical doctor or other clinician. The term "therapeutically effective amount" includes that amount of a compound that, when administered, is sufficient to prevent development of, or alleviate to some extent, one or more of the signs or symptoms of the disorder or disease being treated. The therapeutically effective amount will vary depending on the compound, the disease and its severity and the age, weight, etc., of the subject to be treated.

To "treat" a disease as the term is used herein, means to reduce the frequency or severity of at least one sign or symptom of a disease or disorder experienced by a subject.

The term "transfected" or "transformed" or "transduced" as used herein refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The phrase "under transcriptional control" or "operatively linked" as used herein means that the promoter is in the correct location and orientation in relation to a polynucleotide to control the initiation of transcription by RNA polymerase and expression of the polynucleotide.

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, adenoviral vectors, adeno-associated virus vectors, retroviral vectors, and the like.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

Description

The present invention relates to compositions and methods for inducing an immune response against HCV in a subject. In some embodiments, the present invention relates to sequential lineage antigens of HCV that can be used as immunogens to induce a protective or therapeutic immune response in a subject. In some embodiments, the composition comprises a protein or peptide comprising one or more of the HCV antigens described herein. In some embodiments, the composition comprises a virus, including for example an inactivated virus or attenuated virus, expressing one or more of the HCV antigens described herein. In some embodiments, the composition comprises a nucleic acid molecule, including for example, DNA, cDNA, RNA, and the like, encoding one or more of the HCV antigens described herein.

In some embodiments, the present invention provides a composition comprising a nucleic acid molecule encoding a HCV antigen, where the HCV antigen induces an immune response against HCV in the subject. In some embodiments, the induced immune response is an adaptive immune response. For example, in some embodiments, the composition comprises a vaccine comprising a nucleic acid molecule encoding a HCV antigen. In some embodiments, the HCV antigen induces expression of a protective antibody. In some embodiments, the HCV antigen provides an adjuvant function.

In one embodiment, the composition of the invention comprises in vitro transcribed (IVT) RNA. For example, in some embodiments, the composition of the invention comprises IVT RNA which encodes a HCV antigen, where the HCV antigen induces an adaptive immune response. In some embodiments, the HCV antigen is at least one of HCV envelope (E1 and/or E2) protein, or HCV core (C) protein, or a fragment or variant thereof.

In some embodiments, the HCV antigen is based upon lineage immunogens that are able to initiate and mature an immune response against the rapidly mutating HCV virus. In some embodiments, the HCV antigen is one selected for being maintained in the genome of HCV, even while the HCV genome mutates to avoid immune surveillance.

In some embodiments, the antigen-encoding nucleic acid of the present composition is a nucleoside-modified RNA. The present invention is based in part on the finding that nucleoside-modified RNA encoding a HCV antigen can induce a robust and durable immune response against HCV. Further, the HCV antigen-encoding nucleoside-modified RNA can induce antigen-specific antibody production. Further, the HCV antigen-encoding nucleoside-modified RNA can induce protective T cell responses. The nucleoside-modified RNA is can induce adaptive immune responses that are comparable or superior to current HCV vaccine strategies.

In some embodiments, the antigen-encoding nucleic acid of the present composition is a purified nucleoside-modified RNA. For example, in some embodiments, the composition is purified such that it is free of double-stranded contaminants.

In some embodiments, the composition comprises a lipid nanoparticle (LNP). For example, in one embodiment, the composition comprises a HCV antigen-encoding nucleic acid molecule encapsulated within a LNP. In some instances, the LNP enhances cellular uptake of the nucleic acid molecule.

In some embodiments, the composition comprises an adjuvant. In some embodiments, the composition comprises a nucleic acid molecule encoding an adjuvant. For example, in one embodiment, the composition comprises a nucleoside-modified RNA encoding an adjuvant. In one embodiment, the composition comprises a nucleoside-modified RNA encoding a HCV antigen and an adjuvant. In one embodiment, the composition comprises a first nucleoside-modified RNA, which encodes a HCV antigen, and a second nucleoside-modified RNA, which encodes an adjuvant. In one embodiment, the composition comprises a nucleoside-modified RNA encoding an adjuvant and a LNP, wherein the LNP has adjuvant activity.

In one embodiment, the present invention provides a method for inducing an immune response against HCV in a subject. In some embodiments, the method comprises administering to the subject a composition comprising one or more nucleoside-modified RNA encoding a HCV antigen, adjuvant, or a combination thereof.

In one embodiment, the method comprises the administration of the composition into the subject, including for example intradermal administration or intramuscular administration. In some embodiments, the method comprises administering a plurality of doses to the subject. In another embodiment, the method comprises administering a single dose of the composition, where the single dose is effective in inducing an adaptive immune response. In one embodiment, the method provides a sustained or prolonged immune response.

Vaccine

In one embodiment, the present invention provides an immunogenic composition for inducing an immune response against HCV in a subject. For example, in one embodiment, the immunogenic composition is a vaccine.

For a composition to be useful as a vaccine, the composition must induce an immune response against the HCV antigen in a cell, tissue or mammal (e.g., a human). In some instances, the vaccine induces a protective immune response in the mammal. As used herein, an "immunogenic composition" may comprise an antigen (e.g., a peptide or polypeptide), a nucleic acid encoding an antigen, a cell expressing or presenting an antigen or cellular component, a virus expressing or presenting an antigen or cellular component, or a combination thereof. In particular embodiments, the composition comprises or encodes all or part of any peptide antigen described herein, or an immunogenically functional equivalent thereof. In other embodiments, the composition is in a mixture that comprises an additional immunostimulatory agent or nucleic acids encoding such an agent. Immunostimulatory agents include but are not limited to an additional antigen, an immunomodulator, an antigen presenting cell, lipid nanoparticle, or an adjuvant. In other embodiments, one or more of the additional agent(s) is covalently bonded to the antigen or an immunostimulatory agent, in any combination.

In the context of the present invention, the term "vaccine" refers to a composition that induces an immune response upon inoculation into an animal. In some embodiments, the induced immune response provides protective immunity.

A vaccine of the present invention may vary in its composition of nucleic acid and/or cellular components. In a non-limiting example, a nucleic acid encoding a HCV antigen might also be formulated with an adjuvant. Of course, it will be understood that various compositions described herein may further comprise additional components. For example, one or more vaccine components may be comprised in a lipid, liposome, or lipid nanoparticle. In another non-limiting example, a vaccine may comprise one or more adjuvants. A vaccine of the present invention, and its various components, may be prepared and/or administered by any method disclosed herein or as would be known to one of ordinary skill in the art, in light of the present disclosure.

In various embodiments, the induction of immunity by the expression of the HCV antigen can be detected by observing in vivo or in vitro the response of all or any part of the immune system in the host against the HCV antigen.

For example, a method for detecting the induction of cytotoxic T lymphocytes is well known. A foreign substance that enters the living body is presented to T cells and B cells by the action of antigen presenting cells (APCs). Some T cells that respond to the antigen presented by APC in an antigen specific manner differentiate into cytotoxic T cells (also referred to as cytotoxic T lymphocytes or CTLs) due to stimulation by the antigen. These antigen-stimulated cells then proliferate. This process is referred to herein as "activation" of T cells. Therefore, CTL induction by an epitope of a polypeptide or peptide or combinations thereof can be evaluated by presenting an epitope of a polypeptide or peptide or combinations thereof to a T cell by APC, and detecting the induction of CTL. Furthermore, APCs have the effect of activating B cells, CD4+ T cells, CD8+ T cells, macrophages, eosinophils and NK cells.

A method for evaluating the inducing action of CTL using dendritic cells (DCs) as APC is well known in the art. DC is a representative APC having a robust CTL inducing action among APCs. In the methods of the invention, the epitope of a polypeptide or peptide or combinations thereof is initially expressed by the DC and then this DC is contacted with T cells. Detection of T cells having cytotoxic effects against the cells of interest after the contact with DC shows that the epitope of a polypeptide or peptide or combinations thereof has an activity of inducing the cytotoxic T cells. Furthermore, the induced immune response can also be examined by measuring IFN-gamma produced and released by CTL in the presence of antigen-presenting cells that carry immobilized peptide or a combination of peptides by visualizing using anti-IFN-gamma antibodies, such as an ELISPOT assay.

Apart from DC, peripheral blood mononuclear cells (PBMCs) may also be used as the APC. The induction of CTL is reported to be enhanced by culturing PBMC in the presence of GM-CSF and IL-4. Similarly, CTL has been shown to be induced by culturing PBMC in the presence of keyhole limpet hemocyanin (KLH) and IL-7.

The antigens confirmed to possess CTL-inducing activity by these methods are antigens having DC activation effect and subsequent CTL-inducing activity. Furthermore, CTLs that have acquired cytotoxicity due to presentation of the antigen by APC can be also used as vaccines against antigen-associated disorders.

The induction of immunity by expression of the HCV antigen can be further confirmed by observing the induction of antibody production against the HCV antigen. For example, when antibodies against an antigen are induced in a laboratory animal immunized with the composition encoding the antigen, and when antigen-associated pathology is suppressed by those antibodies, the composition is determined to induce immunity.

The specificity of the antibody response induced in an animal can include binding to many regions of the delivered antigen, as well as, the induction of neutralization capable antibodies that that prevent infection or reduce disease severity.

The induction of immunity by expression of the HCV antigen can be further confirmed by observing the induction of CD4+ T cells. CD4+ T cells can also lyse target cells, but mainly supply help in the induction of other types of immune responses, including CTL and antibody generation. The type of CD4+ T cell help can be characterized, as Th1, Th2, Th9, Th17, Tregulatory (Treg), or T follicular helper (Tfh) cells. Each subtype of CD4+ T cell supplies help to certain types of immune responses. In one embodiment, the composition selectively induces T follicular helper cells, which drive potent antibody responses.

The therapeutic compounds or compositions of the invention may be administered prophylactically (i.e., to prevent a disease or disorder) or therapeutically (i.e., to treat a disease or disorder) to subjects suffering from, or at risk of (or susceptible to) developing a disease or disorder. Such subjects may be identified using standard clinical methods. In the context of the present invention, prophylactic administration occurs prior to the manifestation of overt clinical symptoms of disease, such that a disease or disorder is prevented or alternatively delayed in its progression. In the context of the field of medicine, the term "prevent" encompasses any activity, which reduces the burden of mortality or morbidity from disease. Prevention can occur at primary, secondary and tertiary prevention levels. While primary prevention avoids the development of a disease, secondary and tertiary levels of prevention encompass activities aimed at preventing the progression of a disease and the emergence of symptoms as well as reducing the negative impact of an already established disease by restoring function and reducing disease-related complications.

Antigen

The present invention provides a composition that induces an immune response in a subject. In one embodiment, the composition comprises an HCV antigen. In one embodiment, the composition comprises a nucleic acid sequence, which encodes a HCV antigen, or a fragment or variant thereof. For example, in some embodiments, the composition comprises a nucleoside-modified RNA encoding a HCV antigen, or a fragment or variant thereof. In some embodiments, the composition comprises a purified, nucleoside-modified RNA encoding a HCV antigen, or a fragment or variant thereof. The antigen may include, but is not limited to a polypeptide, peptide, protein, virus, or cell that induces an immune response in a subject.

In one embodiment, the antigen comprises a polypeptide or peptide associated with HCV, such that the antigen induces an immune response against the antigen, and therefore HCV. In one embodiment, the antigen comprises a fragment of a polypeptide or peptide associated with HCV, such that the antigen induces an immune response against HCV.

In some embodiments, the HCV antigen is at least one of HCV envelope E1 protein, HCV envelope E2 protein, HCV core (C) protein, or a fragment thereof.

In some aspects, the core is used to allow the formation of secreted subviral particles containing E1 and E2. In some instances, these secreted particles are a better form for presentation to B cells.

In one embodiment, the antigen comprises a protein comprising a signal peptide (SP) from MHC class II. Other signal peptides that may be used include, but are not limited to, signal sequences derived from IL-2, tPA, mouse and human IgG, and synthetic optimized signal sequences.

In one embodiment, the composition comprises a nucleoside-modified RNA comprising a nucleic acid sequence encoding E1-E2, wherein the nucleic acid sequence is encoded by a DNA sequence comprising at least one of SEQ ID NOs: 1-9 or 37-39, or a fragment or variant thereof, wherein the nucleic acid sequence comprises at least one modified nucleoside.

In one embodiment, the composition comprises a nucleoside-modified RNA comprising a nucleic acid sequence encoding E1-E2 comprising an amino acid sequence comprising at least one of SEQ ID NOs: 10-18, or a fragment or variant thereof, wherein the nucleic acid sequence comprises at least one modified nucleoside.

In some embodiments, the composition comprising a nucleic acid sequence that encodes a HCV core protein. The HCV core protein may be of any HCV isolate.

In one embodiment, the composition comprises a nucleoside-modified RNA comprising a nucleic acid sequence encoding C-E1-E2, wherein the nucleic acid sequence is encoded by a DNA sequence comprising at least one of SEQ ID NOs: 19-27, or a fragment or variant thereof, wherein the nucleic acid sequence comprises at least one modified nucleoside.

In one embodiment, the composition comprises a nucleoside-modified RNA comprising a nucleic acid sequence encoding C-E1-E2 comprising an amino acid sequence comprising at least one of SEQ ID NOs: 28-36, or a fragment or variant thereof, wherein the nucleic acid sequence comprises at least one modified nucleoside.

In one embodiment, the composition comprises a nucleoside-modified RNA comprising a nucleic acid sequence encoding E1-E2, wherein the nucleic acid sequence is encoded by a DNA sequence provided in Example 2, Example 3, or Example 4, or a fragment or variant thereof.

In one embodiment, the composition comprises a nucleoside-modified RNA comprising a nucleic acid sequence encoding E1-E2, wherein the amino acid sequence of E1-E2 is encoded by a DNA sequence provided in Example 2, Example 3, or Example 4, or a fragment or variant thereof.

The HCV antigen may be of any type or strain of HCV. For example, in one embodiment, the HCV antigen is a protein, or fragment thereof, of a HCV strain including, but not limited to, 1a, 1b, 1c, 1e, 1g, 1h, 1l, 2a, 2b, 2c, 2d, 2e, 2i, 2j, 2k, 2m, 2q, 2r, 3a, 3b, 3g, 3h, 3i, 3k, 4a, 4b, 4c, 4d, 4f, 4g, 4k, 4l, 4m, 4n, 4o, 4p, 4q, 4r, 4t, 4v, 4w, 5a, 6a, 6b, 6c, 6d, 6e, 6f, 6g, 6h, 6i, 6j, 6k, 6l, 6m, 6n, 6o, 6p, 6q, 6r, 6s, 6t, 6u, 6v, 6w, 6xa, and 7a, or a fragment or variant thereof.

In some embodiments, the HCV antigen comprises an amino acid sequence that is substantially homologous to the amino acid sequence of a HCV antigen described herein and retains the immunogenic function of the original amino acid sequence. For example, in some embodiments, the amino acid sequence of the HCV antigen has a degree of identity with respect to the original amino acid sequence of at least 60%, of at least 65%, of at least 70%, of at least 75%, of at least 80%, of at least 85%, of at least 90%, of at least 91%, of at least 92%, of at least 93%, of at least 94%, of at least 95%, of at least 96%, of at least 97%, of at least 98%, of at least 99%, or of at least 99.5%.

In one embodiment, the HCV antigen is encoded by a nucleic acid sequence of a nucleic acid molecule. In some embodiments, the nucleic acid sequence comprises DNA, RNA, cDNA, viral DNA, a variant thereof, a fragment thereof, or a combination thereof. In one embodiment, the nucleic acid sequence comprises a modified nucleic acid sequence. For example, in one embodiment the HCV antigen-encoding nucleic acid sequence comprises nucleoside-modified RNA, as described in detail elsewhere herein. In some instances, the nucleic acid sequence comprises include additional sequences that encode linker or tag sequences that are linked to the antigen by a peptide bond.

Lineage Immunogens

The isolation of BnAbs for certain mutating viruses have been recently proposed the use of computationally derived clonal lineages to provide an alternative approach to vaccine design. Three general steps for a lineage-based approach can be envisioned. First, monoclonal antibodies are obtained from a set of clonally related and antigen-specific memory B cells with single-cell technology. This helps identify the native immunoglobulin heavy (VDJ) and light (VJ) gene pairs. Second, computational methods are used to infer the unmutated ancestral BCR (i.e. the presumptive receptor of the naive B cell that binds the antigen and initiates the broadly neutralizing antibody response). In addition, likely intermediate antibodies at key branch points for the development of the clonal lineage are identified. Finally, immunogens are designed that first bind and expand unmutated BCR, followed by intermediate antigens that drive the ancestor BCRs to broadly neutralizing responses. (Reviewed in Nat Biotechnol. 2012 May 7; 30(5): 423-433. doi: 10.1038/nbt.2197)

Adjuvant

In one embodiment, the composition comprises an adjuvant. In one embodiment, the composition comprises a nucleic acid molecule encoding an adjuvant. In one embodiment, the adjuvant-encoding nucleic acid molecule is IVT RNA. In one embodiment, the adjuvant-encoding nucleic acid molecule is nucleoside-modified RNA.

Exemplary adjuvants include, but are not limited to, alpha-interferon, gamma-interferon, platelet derived growth factor (PDGF), TNFα, TNFβ, GM-CSF, epidermal growth factor (EGF), cutaneous T cell-attracting chemokine (CTACK), epithelial thymus-expressed chemokine (TECK), mucosae-associated epithelial chemokine (MEC), IL-12, IL-15, MHC, CD80, CD86. Other genes which may be useful adjuvants include those encoding: MCP-I, MIP-Ia, MIP-Ip, IL-8, RANTES, L-selectin, P-selectin, E-selectin, CD34, GlyCAM-1, MadCAM-1, LFA-I, VLA-I, Mac-1, pl50.95, PECAM, ICAM-I, ICAM-2, ICAM-3, CD2, LFA-3, M-CSF, G-CSF, IL-4, mutant forms of IL-18, CD40, CD40L, vascular growth factor, fibroblast growth factor, IL-7, nerve growth factor, vascular endothelial growth factor, Fas, TNF receptor, Fit, Apo-1, p55, WSL-I, DR3, TRAMP, Apo-3, AIR, LARD, NGRF, DR4, DRS, KILLER, TRAIL-R2, TRICK2, DR6, Caspase ICE, Fos, c-jun, Sp-I, Ap-I, Ap-2, p38, p65Rel, MyD88, IRAK, TRAF6, IkB, Inactive NIK, SAP K, SAP-I, JNK, interferon response genes, NFkB, Bax, TRAIL, TRAILrec, TRAILrecDRC5, TRAIL-R3, TRAIL-R4, RANK, RANK LIGAND, Ox40, Ox40 LIGAND, NKG2D, MICA, MICB, NKG2A, NKG2B, NKG2C, NKG2E, NKG2F, TAP 1, TAP2, anti-CTLA4-sc, anti-LAG3-Ig, anti-TIM3-Ig, and functional fragments thereof.

In some embodiments, the composition comprises a lipid nanoparticle, where the lipid nanoparticle acts as an adjuvant.

Nucleic Acids

In one embodiment, the invention includes a nucleic acid molecule encoding a HCV antigen. In one embodiment, the invention includes a nucleoside-modified nucleic acid molecule. In one embodiment, the nucleoside-modified nucleic acid molecule encodes a HCV antigen. In one embodiment, the nucleoside-modified nucleic acid molecule encodes a plurality of antigens, including one or more HCV antigens. In some embodiments, the nucleoside-modified nucleic acid molecule encodes a HCV antigen that induces an adaptive immune response against the HCV antigen. In one embodiment, the invention includes a nucleoside-modified nucleic acid molecule encoding an adjuvant.

The nucleic acid molecule can be made using any methodology in the art, including, but not limited to, in vitro transcription, chemical synthesis, or the like.

The nucleotide sequences encoding a HCV antigen or adjuvant, as described herein, can alternatively comprise sequence variations with respect to the original nucleotide sequences, for example, substitutions, insertions and/or deletions of one or more nucleotides, with the condition that the resulting polynucleotide encodes a polypeptide according to the invention. Therefore, the scope of the present invention includes nucleotide sequences that are substantially homologous to the nucleotide sequences recited herein and encode a HCV antigen or adjuvant of interest.

As used herein, a nucleotide sequence is "substantially homologous" to any of the nucleotide sequences described herein when its nucleotide sequence has a degree of identity with respect to the original nucleotide sequence at least 60%, of at least 65%, of at least 70%, of at least 75%, of at least 80%, of at least 85%, of at least 90%, of at least 91%, of at least 92%, of at least 93%, of at least 94%, of at least 95%, of at least 96%, of at least 97%, of at least 98%, of at least 99%, or of at least 99.5%. A nucleotide sequence that is substantially homologous to a nucleotide sequence encoding an antigen can typically be isolated from a producer organism of the antigen based on the information contained in the nucleotide sequence by means of introducing conservative or non-conservative substitutions, for example. Other examples of possible modifications include the insertion of one or more nucleotides in the sequence, the addition of one or more nucleotides in any of the ends of the sequence, or the deletion of one or more nucleotides in any end or inside the sequence. The degree of identity between two polynucleotides is determined using computer algorithms and methods that are widely known for the persons skilled in the art.

Further, the scope of the invention includes nucleotide sequences that encode amino acid sequences that are substantially homologous to the amino acid sequences recited herein and preserve the immunogenic function of the original amino acid sequence.

As used herein, an amino acid sequence is "substantially homologous" to any of the amino acid sequences described herein when its amino acid sequence has a degree of identity with respect to the original amino acid sequence of at least 60%, of at least 65%, of at least 70%, of at least 75%, of at least 80%, of at least 85%, of at least 90%, of at least 91%, of at least 92%, of at least 93%, of at least 94%, of at least 95%, of at least 96%, of at least 97%, of at least 98%, of at least 99%, or of at least 99.5%. The identity between two amino acid sequences can be determined by using the BLASTN algorithm (BLAST Manual, Altschul, S., et al., NCBI NLM NIH Bethesda, Md. 20894, Altschul, S., et al., J. Mol. Biol. 215: 403-410 (1990)).

In one embodiment, the invention relates to a construct, comprising a nucleotide sequence encoding a HCV antigen. In one embodiment, the construct comprises a plurality of nucleotide sequences encoding a plurality of HCV antigens. For example, in some embodiments, the construct encodes 1 or more, 2 or more, 3 or more, or all HCV antigens. In one embodiment, the invention relates to a construct, comprising a nucleotide sequence encoding an adjuvant. In one embodiment, the construct comprises a first nucleotide sequence encoding a HCV antigen and a second nucleotide sequence encoding an adjuvant.

In one embodiment, the composition comprises a plurality of constructs, each construct encoding one or more HCV antigens. In some embodiments, the composition comprises 1 or more, 2 or more, 3 or more, 4 or more, 5 or more, 6 or more, 7 or more, 8 or more, 9 or more, 10 or more, 15 or more, or 20 or more constructs. In one embodiment, the composition comprises about 5 to 11 constructs. In one embodiment, the composition comprises a first construct, comprising a nucleotide sequence encoding a HCV antigen; and a second construct, comprising a nucleotide sequence encoding an adjuvant.

In another particular embodiment, the construct is operatively bound to a translational control element. The construct can incorporate an operatively bound regulatory sequence for the expression of the nucleotide sequence of the invention, thus forming an expression cassette.

Vectors

The nucleic acid sequences coding for the HCV antigen or adjuvant can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically.

The nucleic acid can be cloned into a number of types of vectors. For example, the nucleic acid can be cloned into a vector including, but not limited to a plasmid, a phagemid, a phage derivative, an animal virus, a PCR-generated linear DNA sequence, and a cosmid. Vectors of particular interest include expression vectors, replication vectors, probe generation vectors, sequencing vectors and vectors optimized for in vitro transcription.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, carbohydrates, peptides, cationic polymers, and liposomes. An exemplary colloidal system for use as a delivery vehicle in vitro and in vivo is a liposome (e.g., an artificial membrane vesicle).

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/RNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Chol") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to a composition of the present invention, in order to confirm the presence of the mRNA sequence in the host cell, a variety of assays may be performed. Such assays include, for example, "molecular biological" assays well known to those of skill in the art, such as Northern blotting and RT-PCR; "biochemical" assays, such as detecting the presence or absence of a particular peptide, e.g., by immunogenic means (ELISAs and Western blots) or by assays described herein to identify agents falling within the scope of the invention.

In Vitro Transcribed RNA

In one embodiment, the composition of the invention comprises in vitro transcribed (IVT) RNA encoding an HCV antigen. In one embodiment, the composition of the invention comprises IVT RNA encoding a plurality of HCV antigens. In one embodiment, the composition of the invention comprises IVT RNA encoding an adjuvant. In one embodiment, the composition of the invention comprises IVT RNA encoding one or more HCV antigens and one or more adjuvants.

In one embodiment, an IVT RNA can be introduced to a cell as a form of transient transfection. The RNA is produced by in vitro transcription using a plasmid DNA template generated synthetically. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. In one embodiment, the desired template for in vitro transcription is a HCV antigen capable of inducing an adaptive immune response. In one embodiment, the desired template for in vitro transcription is an adjuvant capable of enhancing an adaptive immune response.

In one embodiment, the DNA to be used for PCR contains an open reading frame. The DNA can be from a naturally occurring DNA sequence from the genome of an organism. In one embodiment, the DNA is a full-length gene of interest of a portion of a gene. The gene can include some or all of the 5' and/or 3' untranslated regions (UTRs). The gene can include exons and introns. In one embodiment, the DNA to be used for PCR is a human gene. In another embodiment, the DNA to be used for PCR is a human gene including the 5' and 3' UTRs. In another embodiment, the DNA to be used for PCR is a gene from a pathogenic or commensal organism, including bacteria, viruses, parasites, and fungi. In another embodiment, the DNA to be used for PCR is from a pathogenic or commensal organism, including bacteria, viruses, parasites, and fungi, including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

Genes that can be used as sources of DNA for PCR include genes that encode polypeptides that induce or enhance an adaptive immune response in an organism. In some instances, the genes are useful for a short term treatment. In some instances, the genes have limited safety concerns regarding dosage of the expressed gene.

In various embodiments, a plasmid is used to generate a template for in vitro transcription of mRNA, which is used for transfection.

Chemical structures with the ability to promote stability and/or translation efficiency may also be used. In some embodiments, the RNA has 5' and 3' UTRs. In one embodiment, the 5' UTR is between zero and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the gene of interest. Alternatively, UTR sequences that are not endogenous to the gene of interest can be added by incorporating the UTR sequences into the forward and reverse primers or by any other modifications of the template. The use of UTR sequences that are not endogenous to the gene of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous gene. Alternatively, when a 5' UTR that is not endogenous to the gene of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be derived from an RNA virus whose RNA genome is stable in cells. In other embodiments various nucleotide analogues can be used in the 3' or 5' UTR to impede exonuclease degradation of the mRNA.

To enable synthesis of RNA from a DNA template, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one embodiment, the promoter is a T7 RNA polymerase promoter, as described elsewhere herein. Other useful promoters include, but are not limited to, T3 and SP6 RNA polymerase promoters. Consensus nucleotide sequences for T7, T3 and SP6 promoters are known in the art.

In one embodiment, the mRNA has both a cap on the 5' end and a 3' poly(A) tail which determine ribosome binding, initiation of translation and stability of mRNA in the cell. On a circular DNA template, for instance, plasmid DNA, RNA polymerase produces a long concatameric product, which is not suitable for expression in eukaryotic cells. The transcription of plasmid DNA linearized at the end of the 3' UTR results in normal sized mRNA, which is effective in eukaryotic transfection when it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003)).

The conventional method of integration of polyA/T stretches into a DNA template is molecular cloning. However, polyA/T sequence integrated into plasmid DNA can cause plasmid instability, which can be ameliorated through the use of recombination incompetent bacterial cells for plasmid propagation.

Poly(A) tails of RNAs can be further extended following in vitro transcription with the use of a poly(A) polymerase, such as *E. coli* polyA polymerase (E-PAP) or yeast polyA polymerase. In one embodiment, increasing the length of a poly(A) tail from 100 nucleotides to between 300 and 400 nucleotides results in about a two-fold increase in the translation efficiency of the RNA. Additionally, the attachment of different chemical groups to the 3' end can increase mRNA stability. Such attachment can contain modified/ artificial nucleotides, aptamers and other compounds. For example, ATP analogs can be incorporated into the poly(A) tail using poly(A) polymerase. ATP analogs can further increase the stability of the RNA.

5' caps also provide stability to mRNA molecules. In one embodiment, RNAs produced by the methods to include a 5' cap1 structure. Such cap1 structure can be generated using Vaccinia capping enzyme and 2'-O-methyltransferase enzymes (CellScript, Madison, Wis.). Alternatively, 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001)). In some embodiments RNA of the invention is introduced to a cell with a method comprising the use of TransIT®-mRNA transfection Kit (Minis, Madison Wis.), which, in some instances, provides high efficiency, low toxicity, transfection.

Nucleoside-Modified RNA

In one embodiment, the composition of the present invention comprises a nucleoside-modified nucleic acid encoding a HCV antigen as described herein. In one embodiment, the composition of the present invention comprises a nucleoside-modified nucleic acid encoding a plurality of antigens, including one or more HCV antigens. In one embodiment, the composition of the present invention comprises a nucleoside-modified nucleic acid encoding an adjuvant as described herein. In one embodiment, the composition of the present invention comprises a nucleoside-modified nucleic acid encoding one or more HCV antigens and one or more adjuvants.

In one embodiment, the composition of the present invention comprises a series of nucleoside-modified nucleic acid encoding one or more HCV antigens that change for each subsequent injection to follow the lineage scheme.

For example, in one embodiment, the composition comprises a nucleoside-modified RNA. In one embodiment, the composition comprises a nucleoside-modified mRNA. Nucleoside-modified mRNA have particular advantages over non-modified mRNA, including for example, increased stability, low or absent innate immunogenicity, and enhanced translation. Nucleoside-modified mRNA useful in the present invention is further described in U.S. Pat. Nos. 8,278,036, 8,691,966, and 8,835,108, each of which is incorporated by reference herein in its entirety.

In some embodiments, nucleoside-modified mRNA does not activate any pathophysiologic pathways, translates very efficiently and almost immediately following delivery, and serve as templates for continuous protein production in vivo lasting for several days to weeks (Karikó et al., 2008, Mol Ther 16:1833-1840; Karikó et al., 2012, Mol Ther 20:948-953). The amount of mRNA required to exert a physiological effect is small, making it applicable for human therapy. For example, as described herein, nucleoside-modified mRNA encoding an HCV antigen has demonstrated the ability to induce antigen-specific antibody production. For example, in some instances, antigen encoded by nucleoside-modified mRNA induces greater production of antigen-specific antibody production as compared to antigen encoded by non-modified mRNA.

In some instances, expressing a protein by delivering the encoding mRNA has many benefits over methods that use protein, plasmid DNA or viral vectors. During mRNA transfection, the coding sequence of the desired protein is the only substance delivered to cells, thus avoiding all the side effects associated with plasmid backbones, viral genes, and viral proteins. More importantly, unlike DNA- and viral-based vectors, the mRNA does not carry the risk of being incorporated into the genome and protein production starts immediately after mRNA delivery. For example, high levels of circulating proteins have been measured within 15 to 30 minutes of in vivo injection of the encoding mRNA. In some embodiments, using mRNA rather than the protein also has many advantages. Half-lives of proteins in the circulation or in tissues are often short, thus protein treatment would need frequent dosing, while mRNA provides a template for continuous protein production for several days to weeks. Purification of proteins is problematic and they can contain aggregates and other impurities that cause adverse effects (Kromminga and Schellekens, 2005, Ann NY Acad Sci 1050:257-265).

In some embodiments, the nucleoside-modified RNA comprises the naturally occurring modified-nucleoside pseudouridine. In some embodiments, inclusion of pseudouridine makes the mRNA more stable, non-immunogenic, and highly translatable (Karikó et al., 2008, Mol Ther 16:1833-1840; Anderson et al., 2010, Nucleic Acids Res 38:5884-5892; Anderson et al., 2011, Nucleic Acids Research 39:9329-9338; Karikó et al., 2011, Nucleic Acids Research 39:e142; Karikó et al., 2012, Mol Ther 20:948-953; Karikó et al., 2005, Immunity 23:165-175).

It has been demonstrated that the presence of modified nucleosides, including pseudouridines in RNA suppress their innate immunogenicity (Karikó et al., 2005, Immunity 23:165-175). Further, protein-encoding, in vitro-transcribed RNA containing pseudouridine can be translated more efficiently than RNA containing no or other modified nucleosides (Karikó et al., 2008, Mol Ther 16:1833-1840). Subsequently, it is shown that the presence of pseudouridine improves the stability of RNA (Anderson et al., 2011, Nucleic Acids Research 39:9329-9338) and abates both activation of PKR and inhibition of translation (Anderson et al., 2010, Nucleic Acids Res 38:5884-5892).

Similar effects as described for pseudouridine have also been observed for RNA containing 1-methyl-pseudouridine.

In some embodiments, the nucleoside-modified nucleic acid molecule is a purified nucleoside-modified nucleic acid molecule. For example, in some embodiments, the composition is purified to remove double-stranded contaminants. In some instances, a preparative high-performance liquid chromatography (HPLC) purification procedure is used to obtain pseudouridine-containing RNA that has superior translational potential and no innate immunogenicity (Karikó et al., 2011, Nucleic Acids Research 39:e142). Administering HPLC-purified, pseudouridine-containing RNA coding for erythropoietin into mice and macaques resulted in a significant increase of serum EPO levels (Karikó et al., 2012, Mol Ther 20:948-953), thus confirming that pseudouridine-containing mRNA is suitable for in vivo protein therapy. In some embodiments, the nucleoside-modified nucleic acid molecule is purified using non-HPLC methods. In some instances, the nucleoside-modified nucleic acid molecule is purified using chromatography methods, including but not limited to HPLC and fast protein liquid chromatography (FPLC). An exemplary FPLC-based purification procedure is described in Weissman et al., 2013, Methods Mol Biol, 969: 43-54. Exemplary purification procedures are also described in U.S. Patent Application Publication No. US2016/0032316, which is hereby incorporated by reference in its entirety.

The present invention encompasses RNA, oligoribonucleotide, and polyribonucleotide molecules comprising pseudouridine or a modified nucleoside. In some embodiments, the composition comprises an isolated nucleic acid encoding an antigen, wherein the nucleic acid comprises a pseudouridine or a modified nucleoside. In some embodiments, the composition comprises a vector, comprising an isolated nucleic acid encoding an antigen, adjuvant, or combination thereof, wherein the nucleic acid comprises a pseudouridine or a modified nucleoside.

In one embodiment, the nucleoside-modified RNA of the invention is IVT RNA, as described elsewhere herein. For example, in some embodiments, the nucleoside-modified RNA is synthesized by T7 phage RNA polymerase. In another embodiment, the nucleoside-modified mRNA is synthesized by SP6 phage RNA polymerase. In another embodiment, the nucleoside-modified RNA is synthesized by T3 phage RNA polymerase.

In one embodiment, the modified nucleoside is $m^1acp^3\Psi$ (1-methyl-3-(3-amino-3-carboxypropyl) pseudouridine). In another embodiment, the modified nucleoside is $m^1\Psi$ (1-methylpseudouridine). In another embodiment, the modified nucleoside is $\Psi m$ (2'-O-methylpseudouridine). In another embodiment, the modified nucleoside is $m^5D$ (5-methyldihydrouridine). In another embodiment, the modified nucleoside is $m^3\Psi$ (3-methylpseudouridine). In another embodiment, the modified nucleoside is a pseudouridine moiety that is not further modified. In another embodiment, the modified nucleoside is a monophosphate, diphosphate, or triphosphate of any of the above pseudouridines. In another embodiment, the modified nucleoside is any other pseudouridine-like nucleoside known in the art.

In another embodiment, the nucleoside that is modified in the nucleoside-modified RNA the present invention is uridine (U). In another embodiment, the modified nucleoside is cytidine (C). In another embodiment, the modified nucleoside is adenosine (A). In another embodiment, the modified nucleoside is guanosine (G).

In another embodiment, the modified nucleoside of the present invention is $m^5C$ (5-methylcytidine). In another embodiment, the modified nucleoside is $m^5U$ (5-methyluridine). In another embodiment, the modified nucleoside is $m^6A$ ($N^6$-methyladenosine). In another embodiment, the modified nucleoside is $s^2U$ (2-thiouridine). In another embodiment, the modified nucleoside is $\Psi$ (pseudouridine). In another embodiment, the modified nucleoside is Um (2'-O-methyluridine).

In other embodiments, the modified nucleoside is $m^1A$ (1-methyladenosine); $m^2A$ (2-methyladenosine); Am (2'-O-methyladenosine); $ms^2m^6A$ (2-methylthio-$N^6$-methyladenosine); $i^6A$ ($N^6$-isopentenyladenosine); $ms^2i6A$ (2-methylthio-$N^6$isopentenyladenosine); $io^6A$ ($N^6$-(cis-hydroxyisopentenyl)adenosine); $ms^2io^6A$ (2-methylthio-$N^6$-(cis-hydroxyisopentenyl) adenosine); $g^6A$ ($N^6$-glycinylcarbamoyladenosine); $t^6A$ ($N^6$-threonylcarbamoyladenosine); $ms^2t^6A$ (2-methylthio-$N^6$-threonyl carbamoyladenosine); m6t6A ($N^6$-methyl-$N^6$-threonylcarbamoyladenosine); $hn^6A$ ($N^6$-hydroxynorvalylcarbamoyladenosine); $ms^2hn^6A$ (2-methylthio-$N^6$-hydroxynorvalyl carbamoyladenosine); Ar(p) (2'-O-ribosyladenosine (phosphate)); I (inosine); $m^1I$ (1-methylinosine); $m^1Im$ (1,2'-O-dimethylinosine); $m^3C$ (3-methylcytidine); Cm (2'-O-methylcytidine); $s^2C$ (2-thiocytidine); $ac^4C$ ($N^4$-acetylcytidine); $f^5C$ (5-formylcytidine); $m^5Cm$ (5,2'-O-dimethylcytidine); $ac^4Cm$ ($N^4$-acetyl-2'-O-methylcytidine); $k^2C$ (lysidine); $m^1G$ (1-methylguanosine); $m^2G$ ($N^2$-methylguanosine); $m^7G$ (7-methylguanosine); Gm (2'-O-methylguanosine); $m^2_2G$ ($N^2,N^2$-dimethylguanosine); $m^2Gm$ ($N^2,2'$-O-dimethylguanosine); $m^2Gm$ ($N^2,N^2,2'$-O-trimethylguanosine); Gr(p) (2'-O-ribosylguanosine (phosphate)); yW (wybutosine); $o_2yW$ (peroxywybutosine); OHyW (hydroxywybutosine); OHyW* (undermodified hydroxywybutosine); imG (wyosine); mimG (methylwyosine); Q (queuosine); oQ (epoxyqueuosine); galQ (galactosyl-queuosine); manQ (mannosyl-queuosine); $preQ_0$ (7-cyano-7-deazaguanosine); $preQ_1$ (7-aminomethyl-7-deazaguanosine); (archaeosine); D (dihydrouridine); $m^5Um$ (5,2'-O-dimethyluridine); $s^4U$ (4-thiouridine); $m^5s^2U$ (5-methyl-2-thiouridine); $s^2Um$ (2-thio-2'-O-methyluridine); $acp^3U$ (3-(3-amino-3-carboxypropyl)uridine); $ho^5U$ (5-hydroxyuridine); $mo^5U$ (5-methoxyuridine); $cmo^5U$ (uridine 5-oxyacetic acid); $mcmo^5U$ (uridine 5-oxyacetic acid methyl ester); $chm^5U$ (5-(carboxyhydroxymethyl)uridine)); $mchm^5U$ (5-(carboxyhydroxymethyl)uridine methyl ester); $mcm^5U$ (5-methoxycarbonylmethyluridine); $mcm^5Um$ (5-methoxycarbonylmethyl-2'-O-methyluridine); $mcm^5s^2U$ (5-methoxycarbonylmethyl-2-thiouridine); $nm^5s^2U$ (5-aminomethyl-2-thiouridine); $mnm^5U$ (5-methylaminomethyluridine); $mnm^5s^2U$ (5-methylaminomethyl-2-thiouridine); $mnm^5se^2U$ (5-methylaminomethyl-2-selenouridine); $ncm^5U$ (5-carbamoylmethyluridine); $ncm^5Um$ (5-carbamoylmethyl-2'-O-methyluridine); $cmnm^5U$ (5-carboxymethylaminomethyluridine); $cmnm^5Um$ (5-carboxymethylaminomethyl-2'-O-methyluridine); $cmnm^5s^2U$ (5-carboxymethylaminomethyl-2-thiouridine); $m^6_2A$ ($N^6,N^6$-dimethyladenosine); Im (2'-O-methylinosine); $m^4C$ ($N^4$-methylcytidine); $m^4Cm$ ($N^4,2'$-O-dimethylcytidine); $hm^5C$ (5-hydroxymethylcytidine); $m^3U$ (3-methyluridine); $cm^5U$ (5-carboxymethyluridine); $m^6Am$ ($N^6,2'$-O-dimethyladenosine); $m^6_2Am$ ($N^6,N^6,O$-2'-trimethyladenosine); $m^{2,7}G$ ($N^2,7$-dimethylguanosine); $m^{2,2,7}G$ ($N^2,N^2,7$-trimethylguanosine); $m^3Um$ (3,2'-O-dimethyluridine); $m^5D$ (5-methyldihydrouridine); $f^5Cm$ (5-formyl-2'-O-methylcytidine); $m^1Gm$ (1,2'-O-dimethylguanosine); $m^1Am$ (1,2'-O-dimethyladenosine); $\tau m^5U$ (5-taurinomethyluridine); $\tau m^5s^2U$ (5-taurinomethyl-2-thiouridine)); imG-14 (4-demethylwyosine); imG2 (isowyosine); or $ac^6A$ ($N^6$-acetyladenosine).

In another embodiment, a nucleoside-modified RNA of the present invention comprises a combination of 2 or more of the above modifications. In another embodiment, the nucleoside-modified RNA comprises a combination of 3 or more of the above modifications. In another embodiment, the nucleoside-modified RNA comprises a combination of more than 3 of the above modifications.

In various embodiments, between 0.1% and 100% of the residues in the nucleoside-modified RNA of the present invention are modified (e.g., either by the presence of pseudouridine, 1-methyl-pseudouridine, or another modified nucleoside base). In one embodiment, the fraction of modified residues is 0.1%. In another embodiment, the fraction of modified residues is 0.2%. In another embodiment, the fraction is 0.3%. In another embodiment, the fraction is 0.4%. In another embodiment, the fraction is 0.5%. In another embodiment, the fraction is 0.6%. In another embodiment, the fraction is 0.7%. In another embodiment, the fraction is 0.8%. In another embodiment, the fraction is 0.9%. In another embodiment, the fraction is 1%. In another embodiment, the fraction is 1.5%. In another embodiment, the fraction is 2%. In another embodiment, the fraction is 2.5%. In another embodiment, the fraction is 3%. In another embodiment, the fraction is 4%. In another embodiment, the fraction is 5%. In another embodiment, the fraction is 6%. In another embodiment, the fraction is 7%. In another embodiment, the fraction is 8%. In another embodiment, the fraction is 9%. In another embodiment, the fraction is 10%. In another embodiment, the fraction is 12%. In another embodiment, the fraction is 14%. In another embodiment, the fraction is 16%. In another embodiment, the fraction is 18%. In another embodiment, the fraction is 20%. In another embodiment, the fraction is 25%. In another embodiment, the fraction is 30%. In another embodiment, the fraction is 35%. In another embodiment, the fraction is 40%. In another embodiment, the fraction is 45%. In another embodiment, the fraction is 50%. In another embodiment, the fraction is 55%. In another embodiment, the fraction is 60%. In another embodiment, the fraction is 65%. In another embodiment, the fraction is 70%. In another embodiment, the fraction is 75%. In another embodiment, the fraction is 80%. In another embodiment, the fraction is 85%. In another embodiment, the fraction is 90%. In another embodiment, the fraction is 91%. In another embodiment, the fraction is 92%. In another embodiment, the fraction is 93%. In another embodiment, the fraction is 94%. In another embodiment, the fraction is 95%. In another embodiment, the fraction is 96%. In another embodiment, the fraction is 97%. In another embodiment, the fraction is 98%. In another embodiment, the fraction is 99%. In another embodiment, the fraction is 100%.

In another embodiment, the fraction is less than 5%. In another embodiment, the fraction is less than 3%. In another embodiment, the fraction is less than 1%. In another embodiment, the fraction is less than 2%. In another embodiment, the fraction is less than 4%. In another embodiment, the fraction is less than 6%. In another embodiment, the fraction is less than 8%. In another embodiment, the fraction is less than 10%. In another embodiment, the fraction is less than 12%. In another embodiment, the fraction is less than 15%. In another embodiment, the fraction is less than 20%. In another embodiment, the fraction is less than 30%. In another embodiment, the fraction is less than 40%. In another embodiment, the fraction is less than 50%. In another embodiment, the fraction is less than 60%. In another embodiment, the fraction is less than 70%.

In another embodiment, 0.1% of the residues of a given nucleoside (i.e., uridine, cytidine, guanosine, or adenosine) are modified. In another embodiment, the fraction of modified residues is 0.2%. In another embodiment, the fraction is 0.3%. In another embodiment, the fraction is 0.4%. In another embodiment, the fraction is 0.5%. In another embodiment, the fraction is 0.6%. In another embodiment, the fraction is 0.7%. In another embodiment, the fraction is 0.8%. In another embodiment, the fraction is 0.9%. In another embodiment, the fraction is 1%. In another embodiment, the fraction is 1.5%. In another embodiment, the fraction is 2%. In another embodiment, the fraction is 2.5%. In another embodiment, the fraction is 3%. In another embodiment, the fraction is 4%. In another embodiment, the fraction is 5%. In another embodiment, the fraction is 6%. In another embodiment, the fraction is 7%. In another embodiment, the fraction is 8%. In another embodiment, the fraction is 9%. In another embodiment, the fraction is 10%. In another embodiment, the fraction is 12%. In another embodiment, the fraction is 14%. In another embodiment, the fraction is 16%. In another embodiment, the fraction is 18%. In another embodiment, the fraction is 20%. In another embodiment, the fraction is 25%. In another embodiment, the fraction is 30%. In another embodiment, the fraction is 35%. In another embodiment, the fraction is 40%. In another embodiment, the fraction is 45%. In another embodiment, the fraction is 50%. In another embodiment, the fraction is 55%. In another embodiment, the fraction is 60%. In another embodiment, the fraction is 65%. In another embodiment, the fraction is 70%. In another embodiment, the fraction is 75%. In another embodiment, the fraction is 80%. In another embodiment, the fraction is 85%. In another embodiment, the fraction is 90%. In another embodiment, the fraction is 91%. In another embodiment, the fraction is 92%. In another embodiment, the fraction is 93%. In another embodiment, the fraction is 94%. In another embodiment, the fraction is 95%. In another embodiment, the fraction is 96%. In another embodiment, the fraction is 97%. In another embodiment, the fraction is 98%. In another embodiment, the fraction is 99%. In another embodiment, the fraction is 100%. In another embodiment, the fraction of the given nucleotide that is modified is less than 8%. In another embodiment, the fraction is less than 10%. In another embodiment, the fraction is less than 5%. In another embodiment, the fraction is less than 3%. In another embodiment, the fraction is less than 1%. In another embodiment, the fraction is less than 2%. In another embodiment, the fraction is less than 4%. In another embodiment, the fraction is less than 6%. In another embodiment, the fraction is less than 12%. In another embodiment, the fraction is less than 15%. In another embodiment, the fraction is less than 20%. In another embodiment, the fraction is less than 30%. In another embodiment, the fraction is less than 40%. In another embodiment, the fraction is less than 50%. In another embodiment, the fraction is less than 60%. In another embodiment, the fraction is less than 70%.

In some embodiments, the composition comprises a purified preparation of single-stranded nucleoside modified RNA. For example, in some embodiments, the purified preparation of single-stranded nucleoside modified RNA is substantially free of double stranded RNA (dsRNA). In some embodiments, the purified preparation is at least 90%, or at least 91%, or at least 92%, or at least 93% or at least 94%, or at least 95%, or at least 96%, or at least 97%, or at least 98%, or at least 99%, or at least 99.5%, or at least 99.9% single stranded nucleoside modified RNA, relative to all other nucleic acid molecules (DNA, dsRNA, etc.).

In another embodiment, a nucleoside-modified RNA of the present invention is translated in the cell more efficiently than an unmodified RNA molecule with the same sequence. In another embodiment, the nucleoside-modified RNA exhibits enhanced ability to be translated by a target cell. In another embodiment, translation is enhanced by a factor of 2-fold relative to its unmodified counterpart. In another embodiment, translation is enhanced by a 3-fold factor. In another embodiment, translation is enhanced by a 4-fold factor. In another embodiment, translation is enhanced by a 5-fold factor. In another embodiment, translation is enhanced by a 6-fold factor. In another embodiment, translation is enhanced by a 7-fold factor. In another embodiment, translation is enhanced by an 8-fold factor. In another embodiment, translation is enhanced by a 9-fold factor. In another embodiment, translation is enhanced by a 10-fold factor. In another embodiment, translation is enhanced by a 15-fold factor. In another embodiment, translation is enhanced by a 20-fold factor. In another embodiment, translation is enhanced by a 50-fold factor. In another embodiment, translation is enhanced by a 100-fold factor. In another embodiment, translation is enhanced by a 200-fold factor. In another embodiment, translation is enhanced by a 500-fold factor. In another embodiment, translation is enhanced by a 1000-fold factor. In another embodiment, translation is enhanced by a 2000-fold factor. In another embodiment, the factor is 10-1000-fold. In another embodiment, the factor is 10-100-fold. In another embodiment, the factor is 10-200-fold. In another embodiment, the factor is 10-300-fold. In another embodiment, the factor is 10-500-fold. In another embodiment, the factor is 20-1000-fold. In another embodiment, the factor is 30-1000-fold. In another embodiment, the factor is 50-1000-fold. In another embodiment, the factor is 100-1000-fold. In another embodiment, the factor is 200-1000-fold. In another embodiment, translation is enhanced by any other significant amount or range of amounts.

In another embodiment, the nucleoside-modified antigen-encoding RNA of the present invention induces a significantly more robust adaptive immune response as compared with an unmodified in vitro-synthesized RNA molecule of the same sequence.

In another embodiment, the modified RNA molecule induces an adaptive immune response that is 2-fold greater than its unmodified counterpart. In another embodiment, the adaptive immune response is increased by a 3-fold factor. In another embodiment, the adaptive immune response is increased by a 4-fold factor. In another embodiment, the adaptive immune response is increased by a 5-fold factor. In another embodiment, the adaptive immune response is increased by a 6-fold factor. In another embodiment, the adaptive immune response is increased by a 7-fold factor. In another embodiment, the adaptive immune response is increased by an 8-fold factor. In another embodiment, the adaptive immune response is increased by a 9-fold factor. In another embodiment, the adaptive immune response is increased by a 10-fold factor. In another embodiment, the adaptive immune response is increased by a 15-fold factor. In another embodiment, the adaptive immune response is increased by a 20-fold factor. In another embodiment, the adaptive immune response is increased by a 50-fold factor. In another embodiment, the adaptive immune response is increased by a 100-fold factor. In another embodiment, the adaptive immune response is increased by a 200-fold factor. In another embodiment, the adaptive immune response is increased by a 500-fold factor. In another embodiment, the adaptive immune response is increased by a 1000-fold factor. In another embodiment, the adaptive immune response is increased by a 2000-fold factor. In another embodiment, the adaptive immune response is increased by another fold difference.

In another embodiment, "induces significantly more robust adaptive immune response" refers to a detectable increase in an adaptive immune response. In another embodiment, the term refers to a fold increase in the adaptive immune response (e.g., 1 of the fold increases enumerated above). In another embodiment, the term refers to an increase such that the nucleoside-modified RNA can be administered at a lower dose or frequency than an unmodified RNA molecule while still inducing a similarly effective adaptive immune response. In another embodiment, the increase is such that the nucleoside-modified RNA can be administered using a single dose to induce an effective adaptive immune response.

In another embodiment, the nucleoside-modified RNA of the present invention exhibits significantly less innate immunogenicity than an unmodified in vitro-synthesized RNA molecule of the same sequence. In another embodiment, the modified RNA molecule exhibits an innate immune response that is 2-fold less than its unmodified counterpart. In another embodiment, innate immunogenicity is reduced by a 3-fold factor. In another embodiment, innate immunogenicity is reduced by a 4-fold factor. In another embodiment, innate immunogenicity is reduced by a 5-fold factor. In another embodiment, innate immunogenicity is reduced by a 6-fold factor. In another embodiment, innate immunogenicity is reduced by a 7-fold factor. In another embodiment, innate immunogenicity is reduced by a 8-fold factor. In another embodiment, innate immunogenicity is reduced by a 9-fold factor. In another embodiment, innate immunogenicity is reduced by a 10-fold factor. In another embodiment, innate immunogenicity is reduced by a 15-fold factor. In another embodiment, innate immunogenicity is reduced by a 20-fold factor. In another embodiment, innate immunogenicity is reduced by a 50-fold factor. In another embodiment, innate immunogenicity is reduced by a 100-fold factor. In another embodiment, innate immunogenicity is reduced by a 200-fold factor. In another embodiment, innate immunogenicity is reduced by a 500-fold factor. In another embodiment, innate immunogenicity is reduced by a 1000-fold factor. In another embodiment, innate immunogenicity is reduced by a 2000-fold factor. In another embodiment, innate immunogenicity is reduced by another fold difference.

In another embodiment, "exhibits significantly less innate immunogenicity" refers to a detectable decrease in innate immunogenicity. In another embodiment, the term refers to a fold decrease in innate immunogenicity (e.g., 1 of the fold decreases enumerated above). In another embodiment, the term refers to a decrease such that an effective amount of the nucleoside-modified RNA can be administered without triggering a detectable innate immune response. In another embodiment, the term refers to a decrease such that the nucleoside-modified RNA can be repeatedly administered without eliciting an innate immune response sufficient to detectably reduce production of the protein encoded by the modified RNA. In another embodiment, the decrease is such that the nucleoside-modified RNA can be repeatedly administered without eliciting an innate immune response sufficient to eliminate detectable production of the protein encoded by the modified RNA.

Lipid Nanoparticle

In one embodiment, delivery of nucleoside-modified RNA comprises any suitable delivery method, including exemplary RNA transfection methods described elsewhere herein. In some embodiments, delivery of a nucleoside-modified RNA to a subject comprises mixing the nucleoside-modified RNA with a transfection reagent prior to the step of contacting. In another embodiment, a method of present invention further comprises administering nucleoside-modified RNA together with the transfection reagent. In another embodiment, the transfection reagent is a cationic lipid reagent. In another embodiment, the transfection reagent is a cationic polymer reagent.

In another embodiment, the transfection reagent is a lipid-based transfection reagent. In another embodiment, the transfection reagent is a protein-based transfection reagent. In another embodiment, the transfection reagent is a carbohydrate-based transfection reagent. In another embodiment, the transfection reagent is a cationic lipid-based transfection reagent. In another embodiment, the transfection reagent is a cationic polymer-based transfection reagent. In another embodiment, the transfection reagent is a polyethyleneimine based transfection reagent. In another embodiment, the transfection reagent is calcium phosphate. In another embodiment, the transfection reagent is Lipofectin®, Lipofectamine®, or TransIT®. In another embodiment, the transfection reagent is any other transfection reagent known in the art.

In another embodiment, the transfection reagent forms a liposome. Liposomes, in another embodiment, increase intracellular stability, increase uptake efficiency and improve biological activity. In another embodiment, liposomes are hollow spherical vesicles composed of lipids arranged in a similar fashion as those lipids, which make up the cell membrane. They have, in another embodiment, an internal aqueous space for entrapping water-soluble compounds and range in size from 0.05 to several microns in diameter. In another embodiment, liposomes can deliver RNA to cells in a biologically active form.

In one embodiment, the composition comprises a lipid nanoparticle (LNP) and one or more nucleic acid molecules described herein. For example, in one embodiment, the composition comprises an LNP and one or more nucleoside-modified RNA molecules encoding one or more antigens, adjuvants, or a combination thereof.

The term "lipid nanoparticle" refers to a particle having at least one dimension on the order of nanometers (e.g., 1-1,000 nm), which includes one or more lipids, for example a lipid of Formula (I), (II) or (III). In some embodiments, lipid nanoparticles are included in a formulation comprising a nucleoside-modified RNA as described herein. In some embodiments, such lipid nanoparticles comprise a cationic lipid (e.g., a lipid of Formula (I), (II) or (III)) and one or more excipient selected from neutral lipids, charged lipids, steroids and polymer conjugated lipids (e.g., a pegylated lipid such as a pegylated lipid of structure (IV), such as compound Iva). In some embodiments, the nucleoside-modified RNA is encapsulated in the lipid portion of the lipid nanoparticle or an aqueous space enveloped by some or all of the lipid portion of the lipid nanoparticle, thereby protecting it from enzymatic degradation or other undesirable effects induced by the mechanisms of the host organism or cells, e.g., an adverse immune response.

In various embodiments, the lipid nanoparticles have a mean diameter of from about 30 nm to about 150 nm, from about 40 nm to about 150 nm, from about 50 nm to about 150 nm, from about 60 nm to about 130 nm, from about 70 nm to about 110 nm, from about 70 nm to about 100 nm, from about 80 nm to about 100 nm, from about 90 nm to about 100 nm, from about 70 nm to about 90 nm, from about 80 nm to about 90 nm, from about 70 nm to about 80 nm, or about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm, and are substantially non-toxic. In some embodiments, the nucleoside-modified RNA, when present in the lipid nanoparticles, is resistant in aqueous solution to degradation with a nuclease.

The LNP may comprise any lipid capable of forming a particle to which the one or more nucleic acid molecules are attached, or in which the one or more nucleic acid molecules are encapsulated. The term "lipid" refers to a group of organic compounds that are derivatives of fatty acids (e.g., esters) and are generally characterized by being insoluble in water but soluble in many organic solvents. Lipids are usually divided in at least three classes: (1) "simple lipids" which include fats and oils as well as waxes; (2) "compound lipids" which include phospholipids and glycolipids; and (3) "derived lipids" such as steroids.

In one embodiment, the LNP comprises one or more cationic lipids, and one or more stabilizing lipids. Stabilizing lipids include neutral lipids and pegylated lipids.

In one embodiment, the LNP comprises a cationic lipid. As used herein, the term "cationic lipid" refers to a lipid that is cationic or becomes cationic (protonated) as the pH is lowered below the pK of the ionizable group of the lipid, but is progressively more neutral at higher pH values. At pH values below the pK, the lipid is then able to associate with negatively charged nucleic acids. In some embodiments, the cationic lipid comprises a zwitterionic lipid that assumes a positive charge on pH decrease.

In some embodiments, the cationic lipid comprises any of a number of lipid species which carry a net positive charge at a selective pH, such as physiological pH. Such lipids include, but are not limited to, N,N-dioleyl-N,N-dimethylammonium chloride (DODAC); N-(2,3-dioleyloxy)propyl)-N,N,N-trimethylammonium chloride (DOTMA); N,N-distearyl-N,N-dimethylammonium bromide (DDAB); N-(2,3-dioleoyloxy)propyl)-N,N,N-trimethylammonium chloride (DOTAP); 3-(N-(N',N'-dimethylaminoethane)-carbamoyl) cholesterol (DC-Chol), N-(1-(2,3-dioleoyloxy)propyl)-N-2-(sperminecarboxamido)ethyl)-N,N-dimethylammonium trifluoracetate (DOSPA), dioctadecylamidoglycyl carboxyspermine (DOGS), 1,2-dioleoyl-3-dimethylammonium propane (DODAP), N,N-dimethyl-2,3-dioleoyloxy) propylamine (DODMA), and N-(1,2-dimyristyloxyprop-3-yl)-N,N-dimethyl-N-hydroxyethyl ammonium bromide (DMRIE). Additionally, a number of commercial preparations of cationic lipids are available which can be used in the present invention. These include, for example, LIPOFECTIN® (commercially available cationic liposomes comprising DOTMA and 1,2-dioleoyl-sn-3-phosphoethanolamine (DOPE), from GIBCO/BRL, Grand Island, N.Y.); LIPOFECTAMINE® (commercially available cationic liposomes comprising N-(1-(2,3-dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.). The following lipids are cationic and have a positive charge at below physiological pH: DODAP, DODMA, DMDMA, 1,2-dilinoleyloxy-N,N-dimethylaminopropane (DLinDMA), 1,2-dilinolenyloxy-N,N-dimethylaminopropane (DLenDMA).

In one embodiment, the cationic lipid is an amino lipid. Suitable amino lipids useful in the invention include those described in WO 2012/016184, incorporated herein by reference in its entirety. Representative amino lipids include, but are not limited to, 1,2-dilinoleyoxy-3-(dimethylamino) acetoxypropane (DLin-DAC), 1,2-dilinoleyoxy-3-morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3-dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N,N-dilinoleylamino)-1,2-propanediol (DLinAP), 3-(N,N-dioleylamino)-1,2-propanediol (DOAP), 1,2-dilinoleyloxo-3-(2-N,N- dimethylamino)ethoxypropane (DLin-EG-DMA), and 2,2-dilinoleyl-4-dimethylaminomethyl[1,3]-dioxolane (DLin-K-DMA).

Suitable amino lipids include those having the formula:

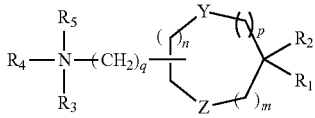

wherein $R_1$ and $R_2$ are either the same or different and independently optionally substituted $C_{10}$-$C_{24}$ alkyl, optionally substituted $C_{10}$-$C_{24}$ alkenyl, optionally substituted $C_{10}$-$C_{24}$ alkynyl, or optionally substituted $C_{10}$-$C_{24}$ acyl;

$R_3$ and $R_4$ are either the same or different and independently optionally substituted $C_1$-$C_6$ alkyl, optionally substituted $C_2$-$C_6$ alkenyl, or optionally substituted $C_2$-$C_6$ alkynyl or $R_3$ and $R_4$ may join to form an optionally substituted heterocyclic ring of 4 to 6 carbon atoms and 1 or 2 heteroatoms chosen from nitrogen and oxygen;

$R_5$ is either absent or present and when present is hydrogen or $C_1$-$C_6$ alkyl;

m, n, and p are either the same or different and independently either 0 or 1 with the proviso that m, n, and p are not simultaneously 0;

q is 0, 1, 2, 3, or 4; and

Y and Z are either the same or different and independently O, S, or NH.

In one embodiment, $R_1$ and $R_2$ are each linoleyl, and the amino lipid is a dilinoleyl amino lipid. In one embodiment, the amino lipid is a dilinoleyl amino lipid.

A representative useful dilinoleyl amino lipid has the formula:

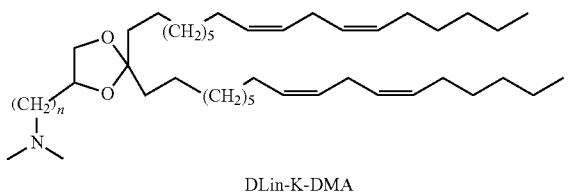

DLin-K-DMA wherein n is 0, 1, 2, 3, or 4.

In one embodiment, the cationic lipid is a DLin-K-DMA. In one embodiment, the cationic lipid is DLin-KC2-DMA (DLin-K-DMA above, wherein n is 2).

In one embodiment, the cationic lipid component of the LNPs has the structure of Formula (I):

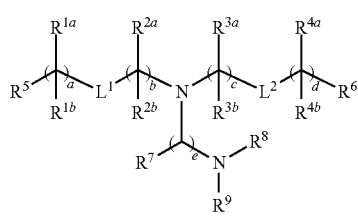

(I)

or a pharmaceutically acceptable salt, tautomer, prodrug or stereoisomer thereof, wherein:

$L^1$ and $L^2$ are each independently —O(C=O)—, —(C=O)O— or a carbon-carbon double bond;

$R^{1a}$ and $R^{1b}$ are, at each occurrence, independently either (a) H or $C_1$-$C_{12}$ alkyl, or (b) $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either (a) H or $C_1$-$C_{12}$ alkyl, or (b) $R^{2a}$ is H or $C_1$-$C_{12}$ alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either (a) H or $C_1$-$C_{12}$ alkyl, or (b) $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either (a) H or $C_1$-$C_{12}$ alkyl, or (b) $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently methyl or cycloalkyl;

$R^7$ is, at each occurrence, independently H or $C_1$-$C_{12}$ alkyl;

$R^8$ and $R^9$ are each independently $C_1$-$C_{12}$ alkyl; or $R^8$ and $R^9$, together with the nitrogen atom to which they are attached, form a 5, 6 or 7-membered heterocyclic ring comprising one nitrogen atom;

a and d are each independently an integer from 0 to 24;

b and c are each independently an integer from 1 to 24; and e is 1 or 2.

In some embodiments of Formula (I), at least one of $R^{1a}$, $R^{2a}$, $R^{3a}$ or $R^{4a}$ is $C_1$-$C_{12}$ alkyl, or at least one of $L^1$ or $L^2$ is —O(C=O)— or —(C=O)O—. In other embodiments, $R^{1a}$ and $R^{1b}$ are not isopropyl when a is 6 or n-butyl when a is 8.

In still further embodiments of Formula (I), at least one of $R^{1a}$, $R^{2a}$, $R^{3a}$ or $R^{4a}$ is $C_1$-$C_{12}$ alkyl, or at least one of $L^1$ or $L^2$ is —O(C=O)— or —(C=O)O—; and $R^{1a}$ and $R^{1b}$ are not isopropyl when a is 6 or n-butyl when a is 8.

In other embodiments of Formula (I), $R^8$ and $R^9$ are each independently unsubstituted $C_1$-$C_{12}$ alkyl; or $R^8$ and $R^9$, together with the nitrogen atom to which they are attached, form a 5, 6 or 7-membered heterocyclic ring comprising one nitrogen atom;

In some embodiments of Formula (I), any one of $L^1$ or $L^2$ may be —O(C=O)— or a carbon-carbon double bond. $L^1$ and $L^2$ may each be —O(C=O)— or may each be a carbon-carbon double bond.

In some embodiments of Formula (I), one of $L^1$ or $L^2$ is —O(C=O)—. In other embodiments, both $L^1$ and $L^2$ are —O(C=O)—.

In some embodiments of Formula (I), one of $L^1$ or $L^2$ is —(C=O)O—. In other embodiments, both $L^1$ and $L^2$ are —(C=O)O—.

In some other embodiments of Formula (I), one of $L^1$ or $L^2$ is a carbon-carbon double bond. In other embodiments, both $L^1$ and $L^2$ are a carbon-carbon double bond.

In still other embodiments of Formula (I), one of $L^1$ or $L^2$ is —O(C=O)— and the other of $L^1$ or $L^2$ is —(C=O)O—. In more embodiments, one of $L^1$ or $L^2$ is —O(C=O)— and the other of $L^1$ or $L^2$ is a carbon-carbon double bond. In yet more embodiments, one of $L^1$ or $L^2$ is —(C=O)O— and the other of $L^1$ or $L^2$ is a carbon-carbon double bond.

It is understood that "carbon-carbon" double bond, as used throughout the specification, refers to one of the following structures:

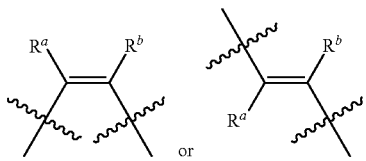

wherein $R^a$ and $R^b$ are, at each occurrence, independently H or a substituent. For example, in some embodiments $R^a$ and $R^b$ are, at each occurrence, independently H, $C_1$-$C_{12}$ alkyl or cycloalkyl, for example H or $C_1$-$C_{12}$ alkyl.

In other embodiments, the lipid compounds of Formula (I) have the following structure (Ia):

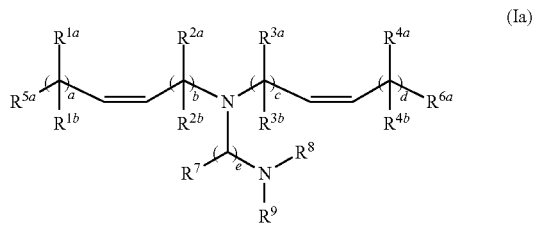

In other embodiments, the lipid compounds of Formula (I) have the following structure (Ib):

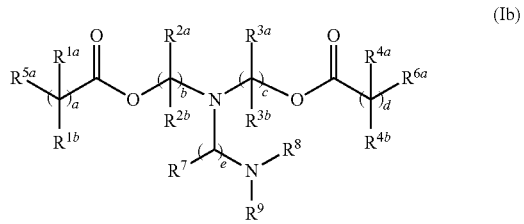

In yet other embodiments, the lipid compounds of Formula (I) have the following structure (Ic):

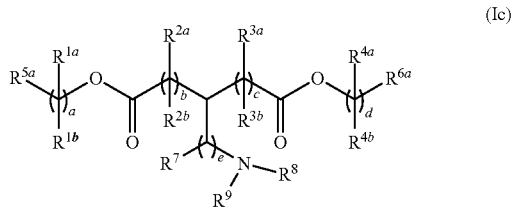

In some embodiments of the lipid compound of Formula (I), a, b, c and d are each independently an integer from 2 to 12 or an integer from 4 to 12. In other embodiments, a, b, c and d are each independently an integer from 8 to 12 or 5 to 9. In some embodiments, a is 0. In some embodiments, a is 1. In other embodiments, a is 2. In more embodiments, a is 3. In yet other embodiments, a is 4. In some embodiments, a is 5. In other embodiments, a is 6. In more embodiments, a is 7. In yet other embodiments, a is 8. In some embodiments, a is 9. In other embodiments, a is 10. In more embodiments, a is 11. In yet other embodiments, a is 12. In some embodiments, a is 13. In other embodiments, a is 14. In more embodiments, a is 15. In yet other embodiments, a is 16.

In some other embodiments of Formula (I), b is 1. In other embodiments, b is 2. In more embodiments, b is 3. In yet other embodiments, b is 4. In some embodiments, b is 5. In other embodiments, b is 6. In more embodiments, b is 7. In yet other embodiments, b is 8. In some embodiments, b is 9. In other embodiments, b is 10. In more embodiments, b is 11. In yet other embodiments, b is 12. In some embodiments, b is 13. In other embodiments, b is 14. In more embodiments, b is 15. In yet other embodiments, b is 16.

In some more embodiments of Formula (I), c is 1. In other embodiments, c is 2. In more embodiments, c is 3. In yet other embodiments, c is 4. In some embodiments, c is 5. In other embodiments, c is 6. In more embodiments, c is 7. In yet other embodiments, c is 8. In some embodiments, c is 9. In other embodiments, c is 10. In more embodiments, c is 11. In yet other embodiments, c is 12. In some embodiments, c is 13. In other embodiments, c is 14. In more embodiments, c is 15. In yet other embodiments, c is 16.

In some other embodiments of Formula (I), d is 0. In some embodiments, d is 1. In other embodiments, d is 2. In more embodiments, d is 3. In yet other embodiments, d is 4. In some embodiments, d is 5. In other embodiments, d is 6. In more embodiments, d is 7. In yet other embodiments, d is 8. In some embodiments, d is 9. In other embodiments, d is 10. In more embodiments, d is 11. In yet other embodiments, d is 12. In some embodiments, d is 13. In other embodiments, d is 14. In more embodiments, d is 15. In yet other embodiments, d is 16.

In some other various embodiments of Formula (I), a and d are the same. In some other embodiments, b and c are the same. In some other specific embodiments, a and d are the same and b and c are the same.

The sum of a and b and the sum of c and d in Formula (I) are factors which may be varied to obtain a lipid of Formula (I) having the desired properties. In one embodiment, a and b are chosen such that their sum is an integer ranging from 14 to 24. In other embodiments, c and d are chosen such that their sum is an integer ranging from 14 to 24. In further embodiment, the sum of a and b and the sum of c and d are the same. For example, in some embodiments the sum of a and b and the sum of c and d are both the same integer which may range from 14 to 24. In still more embodiments, a, b, c and d are selected such the sum of a and b and the sum of c and d is 12 or greater.

In some embodiments of Formula (I), e is 1. In other embodiments, e is 2.

The substituents at $R^{1a}$, $R^{2a}$, $R^{3a}$ and $R^{4a}$ of Formula (I) are not particularly limited. In some embodiments $R^{1a}$, $R^{2a}$, $R^{3a}$ and $R^{4a}$ are H at each occurrence. In some other embodiments at least one of $R^{1a}$, $R^{2a}$, $R^{3a}$ and $R^{4a}$ is $C_1$-$C_{12}$ alkyl. In some other embodiments at least one of $R^{1a}$, $R^{2a}$, $R^{3a}$ and $R^{4a}$ is $C_1$-$C_8$ alkyl. In some other embodiments at least one of $R^{1a}$, $R^{2a}$, $R^{3a}$ and $R^{4a}$ is $C_1$-$C_6$ alkyl. In some of the foregoing embodiments, the $C_1$-$C_8$ alkyl is methyl, ethyl, n-propyl, iso-propyl, n-butyl, iso-butyl, tert-butyl, n-hexyl or n-octyl.

In some embodiments of Formula (I), $R^{1a}$, $R^{1b}$, $R^{4a}$ and $R^{4b}$ are $C_1$-$C_{12}$ alkyl at each occurrence.

In further embodiments of Formula (I), at least one of $R^{1b}$, $R^{2b}$, $R^{3b}$ and $R^{4b}$ is H or $R^{1b}$, $R^{2b}$, $R^{3b}$ and $R^{4b}$ are H at each occurrence.

In some embodiments of Formula (I), $R^{1b}$ together with the carbon atom to which it is bound is taken together with an adjacent $R^{1b}$ and the carbon atom to which it is bound to form a carbon-carbon double bond. In other embodiments of the foregoing $R^{4b}$ together with the carbon atom to which it is bound is taken together with an adjacent $R^{4b}$ and the carbon atom to which it is bound to form a carbon-carbon double bond.

The substituents at $R^5$ and $R^6$ of Formula (I) are not particularly limited in the foregoing embodiments. In some embodiments one or both of $R^5$ or $R^6$ is methyl. In some other embodiments one or both of $R^5$ or $R^6$ is cycloalkyl for example cyclohexyl. In these embodiments the cycloalkyl may be substituted or not substituted. In some other embodiments the cycloalkyl is substituted with $C_1$-$C_{12}$ alkyl, for example tert-butyl.

The substituents at $R^7$ are not particularly limited in the foregoing embodiments of Formula (I). In some embodiments at least one $R^7$ is H. In some other embodiments, $R^7$ is H at each occurrence. In some other embodiments $R^7$ is $C_1$-$C_{12}$ alkyl.

In some other of the foregoing embodiments of Formula (I), one of $R^8$ or $R^9$ is methyl. In other embodiments, both $R^8$ and $R^9$ are methyl.

In some different embodiments of Formula (I), $R^8$ and $R^9$, together with the nitrogen atom to which they are attached, form a 5, 6 or 7-membered heterocyclic ring. In some embodiments of the foregoing, $R^8$ and $R^9$, together with the nitrogen atom to which they are attached, form a 5-membered heterocyclic ring, for example a pyrrolidinyl ring.

In various different embodiments, the lipid of Formula (I) has one of the structures set forth in Table 1 below.

TABLE 1

Representative Lipids of Formula (I)

| No. | Structure | Prep. Method |
|---|---|---|
| I-1 | 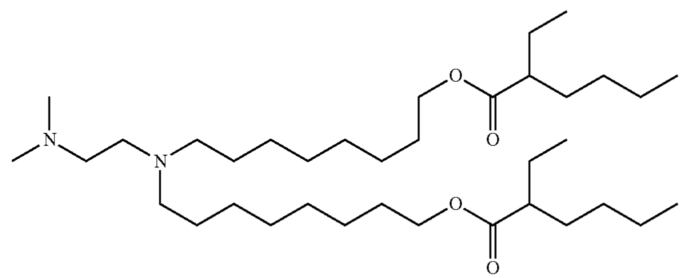 [SMILES: CCCCC(CC)C(=O)OCCCCCCCCN(CCCCCCCCOC(=O)C(CC)CCCC)CCN(C)C] | B |
| I-2 | 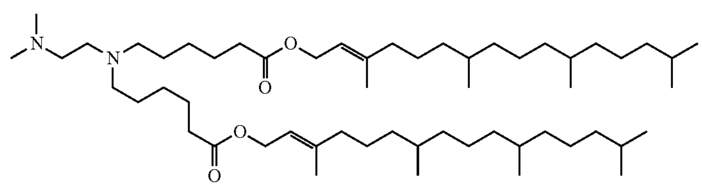 [SMILES: C/C(=C\COC(=O)CCCCCN(CCCCCC(=O)OC/C=C(\C)CCCC(C)CCCC(C)CCCC(C)C)CCN(C)C)CCCC(C)CCCC(C)CCCC(C)C] | A |
| I-3 | 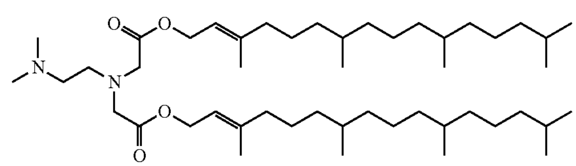 [SMILES: C/C(=C\COC(=O)CN(CCN(C)C)CC(=O)OC/C=C(\C)CCCC(C)CCCC(C)CCCC(C)C)CCCC(C)CCCC(C)CCCC(C)C] | A |
| I-4 | 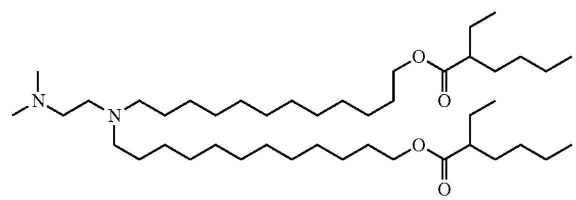 [SMILES: CCCCC(CC)C(=O)OCCCCCCCCCCCCN(CCCCCCCCCCCCOC(=O)C(CC)CCCC)CCN(C)C] | B |
| I-5 | 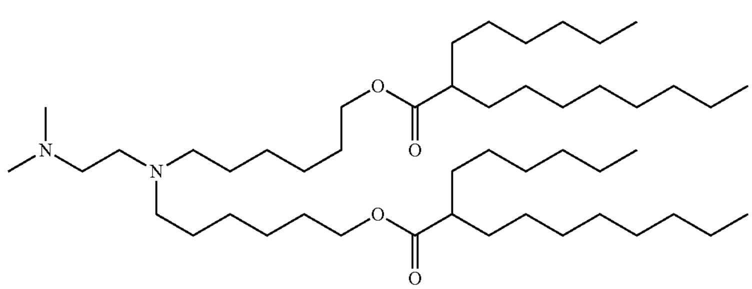 [SMILES: CCCCCCCCC(CCCCCC)C(=O)OCCCCCCN(CCCCCCOC(=O)C(CCCCCC)CCCCCCCC)CCN(C)C] | B |

TABLE 1-continued

Representative Lipids of Formula (I)

| No. | Structure | Prep. Method |
|---|---|---|
| I-6 | 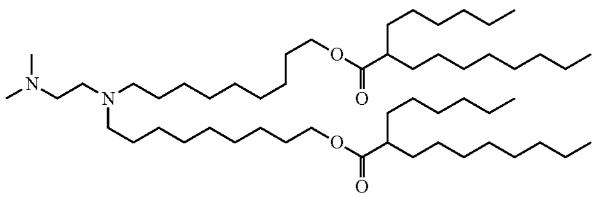 [SMILES: CCCCCCCCC(CCCCCC)C(=O)OCCCCCCCCCN(CCCCCCCCCOC(=O)C(CCCCCC)CCCCCCCC)CCN(C)C] | B |
| I-7 | 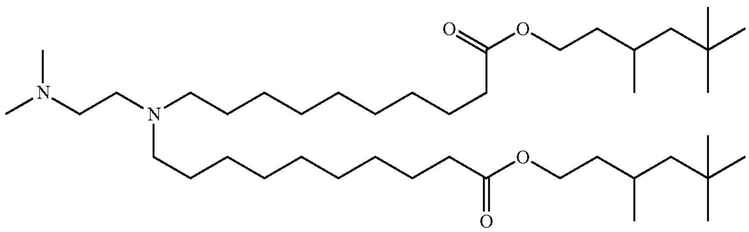 [SMILES: CC(CCOC(=O)CCCCCCCCCN(CCCCCCCCCC(=O)OCCC(C)CC(C)(C)C)CCN(C)C)CC(C)(C)C] | A |
| I-8 | 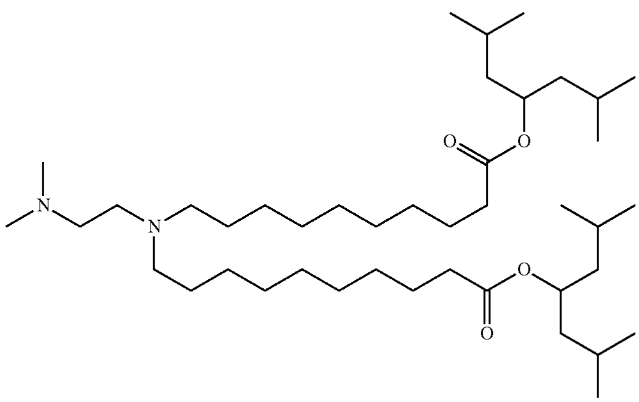 [SMILES: CC(C)CC(CC(C)C)OC(=O)CCCCCCCCCN(CCCCCCCCCC(=O)OC(CC(C)C)CC(C)C)CCN(C)C] | A |
| I-9 | 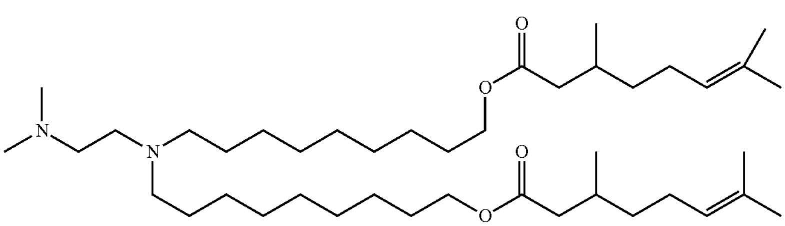 [SMILES: CC(C)=CCCC(C)CC(=O)OCCCCCCCCCN(CCCCCCCCCOC(=O)CC(C)CCC=C(C)C)CCN(C)C] | B |
| I-10 | 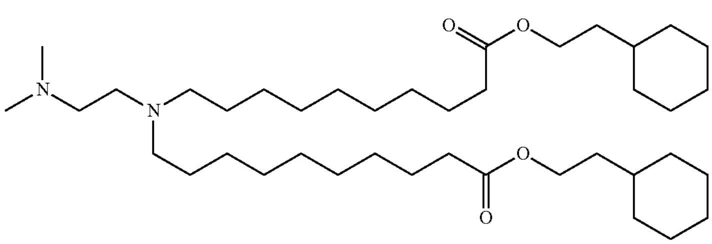 [SMILES: CN(C)CCN(CCCCCCCCCC(=O)OCCC1CCCCC1)CCCCCCCCCC(=O)OCCC1CCCCC1] | A |
| I-11 | 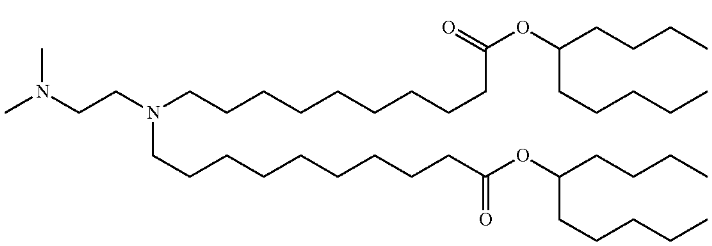 [SMILES: CCCCCC(CCCC)OC(=O)CCCCCCCCCN(CCCCCCCCCC(=O)OC(CCCC)CCCCC)CCN(C)C] | A |

TABLE 1-continued

Representative Lipids of Formula (I)

| No. | Structure | Prep. Method |
|---|---|---|
| I-12 | 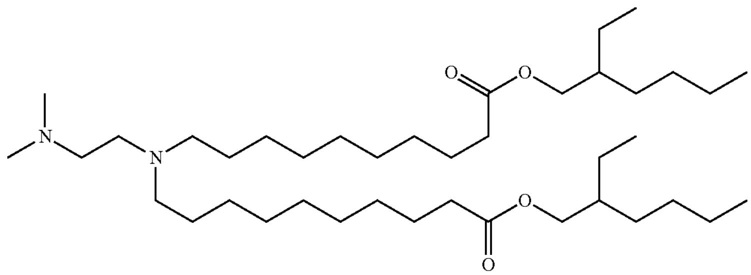 [SMILES: CCCCC(CC)COC(=O)CCCCCCCCCN(CCCCCCCCCC(=O)OCC(CC)CCCC)CCN(C)C] | A |
| I-13 | 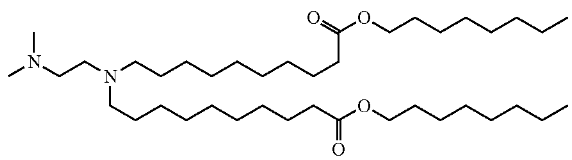 [SMILES: CCCCCCCCOC(=O)CCCCCCCCCN(CCCCCCCCCC(=O)OCCCCCCCC)CCN(C)C] | A |
| I-14 | 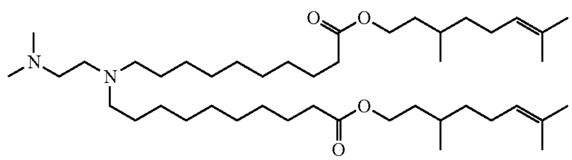 [SMILES: CC(C)=CCCC(C)CCOC(=O)CCCCCCCCCN(CCCCCCCCCC(=O)OCCC(C)CCC=C(C)C)CCN(C)C] | A |
| I-15 | 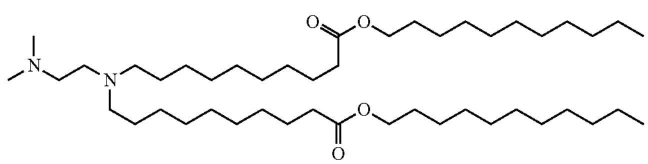 [SMILES: CCCCCCCCCCCOC(=O)CCCCCCCCCN(CCCCCCCCCC(=O)OCCCCCCCCCCC)CCN(C)C] | A |
| I-16 | 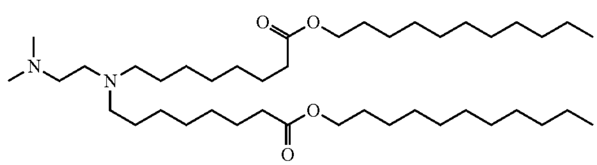 [SMILES: CCCCCCCCCCCOC(=O)CCCCCCCN(CCCCCCCC(=O)OCCCCCCCCCCC)CCN(C)C] | A |
| I-17 | 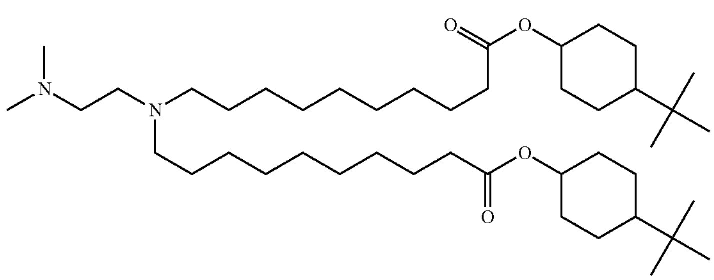 [SMILES: CN(C)CCN(CCCCCCCCCC(=O)OC1CCC(C(C)(C)C)CC1)CCCCCCCCCC(=O)OC1CCC(C(C)(C)C)CC1] | A |
| I-18 | 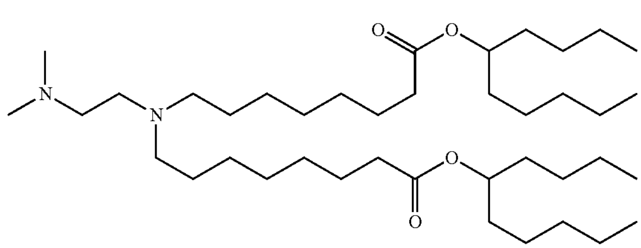 [SMILES: CCCCCC(CCCC)OC(=O)CCCCCCCN(CCCCCCCC(=O)OC(CCCC)CCCCC)CCN(C)C] | A |

TABLE 1-continued

Representative Lipids of Formula (I)

| No. | Structure | Prep. Method |
|---|---|---|
| I-19 | 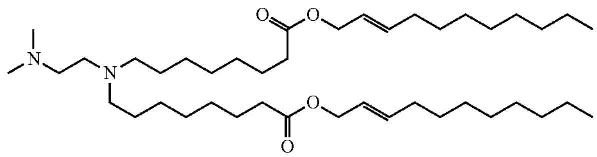 [SMILES: CCCCCCCC/C=C/COC(=O)CCCCCCCN(CCCCCCCC(=O)OC/C=C/CCCCCCCC)CCN(C)C] | A |
| I-20 | 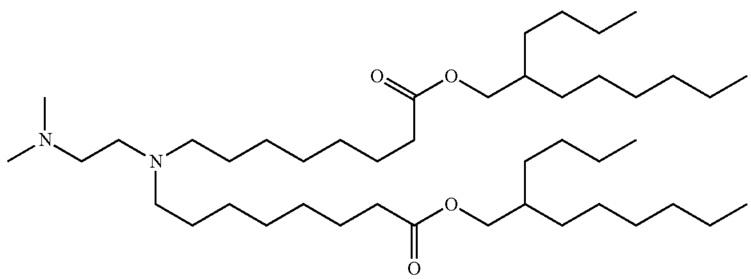 [SMILES: CCCCCCC(CCCC)COC(=O)CCCCCCCN(CCCCCCCC(=O)OCC(CCCC)CCCCCC)CCN(C)C] | A |
| I-21 | 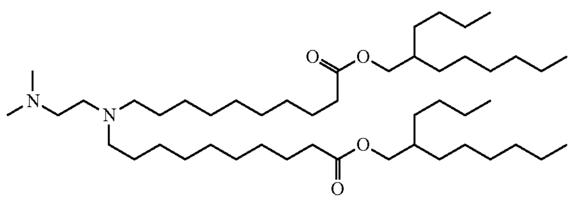 [SMILES: CCCCCCC(CCCC)COC(=O)CCCCCCCCCN(CCCCCCCCCC(=O)OCC(CCCC)CCCCCC)CCN(C)C] | A |
| I-22 | 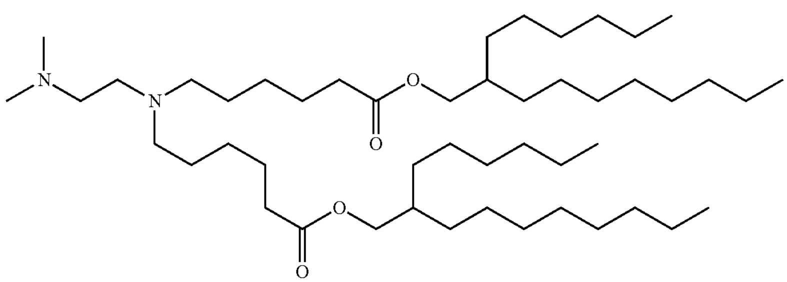 [SMILES: CCCCCCCCC(CCCCCC)COC(=O)CCCCCN(CCCCCC(=O)OCC(CCCCCC)CCCCCCCC)CCN(C)C] | A |
| I-23 | 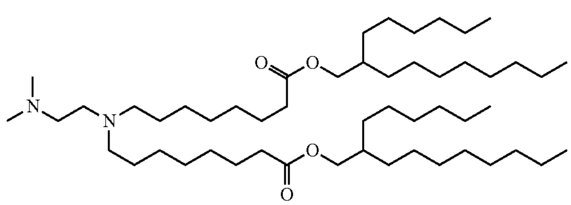 [SMILES: CCCCCCCCC(CCCCCC)COC(=O)CCCCCCCN(CCCCCCCC(=O)OCC(CCCCCC)CCCCCCCC)CCN(C)C] | A |
| I-24 | 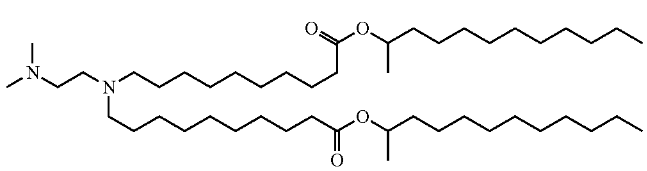 [SMILES: CCCCCCCCCCC(C)OC(=O)CCCCCCCCCN(CCCCCCCCCC(=O)OC(C)CCCCCCCCCC)CCN(C)C] | A |
| I-25 | 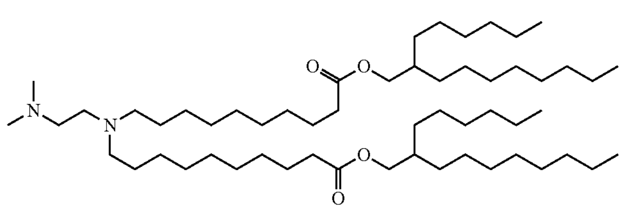 [SMILES: CCCCCCCCC(CCCCCC)COC(=O)CCCCCCCCCN(CCCCCCCCCC(=O)OCC(CCCCCC)CCCCCCCC)CCN(C)C] | A |

TABLE 1-continued

Representative Lipids of Formula (I)

| No. | Structure | Prep. Method |
|---|---|---|
| I-26 | 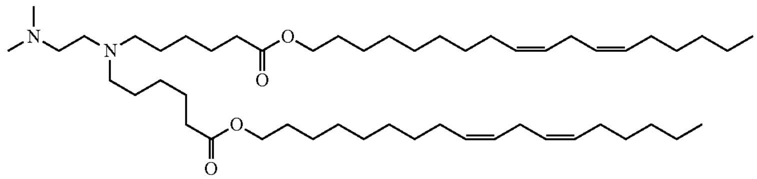 [SMILES: CCCCC/C=C\C/C=C\CCCCCCCCOC(=O)CCCCCN(CCCCCC(=O)OCCCCCCCC/C=C\C/C=C\CCCCC)CCN(C)C] | A |
| I-27 | 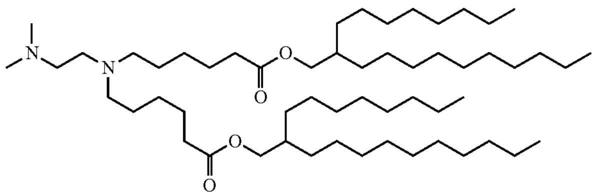 [SMILES: CCCCCCCCCCC(CCCCCCCC)COC(=O)CCCCCN(CCCCCC(=O)OCC(CCCCCCCC)CCCCCCCCCC)CCN(C)C] | A |
| I-28 | 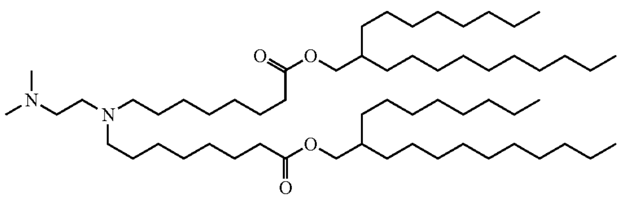 [SMILES: CCCCCCCCCCC(CCCCCCCC)COC(=O)CCCCCCCN(CCCCCCCC(=O)OCC(CCCCCCCC)CCCCCCCCCC)CCN(C)C] | A |
| I-29 | 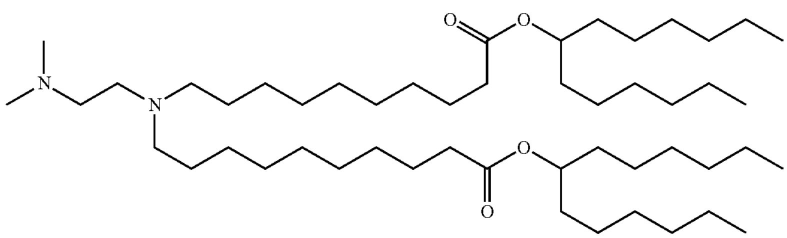 [SMILES: CCCCCCC(CCCCCC)OC(=O)CCCCCCCCCN(CCCCCCCCCC(=O)OC(CCCCCC)CCCCCC)CCN(C)C] | A |
| I-30 | 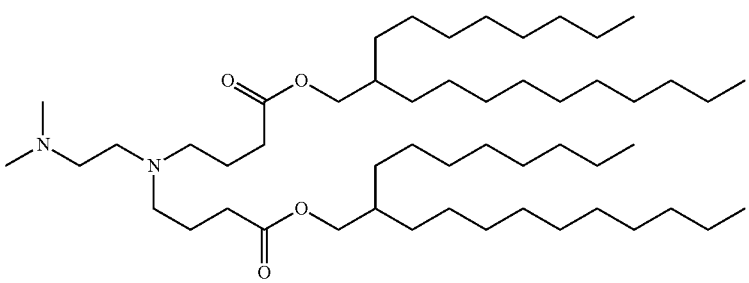 [SMILES: CCCCCCCCCCC(CCCCCCCC)COC(=O)CCCN(CCCC(=O)OCC(CCCCCCCC)CCCCCCCCCC)CCN(C)C] | A |
| I-31 | 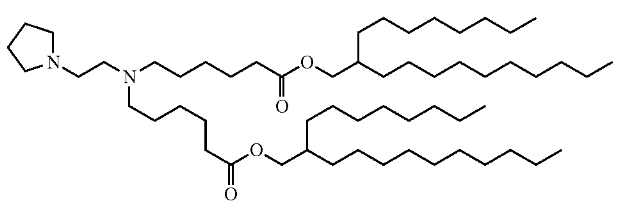 [SMILES: CCCCCCCCCCC(CCCCCCCC)COC(=O)CCCCCN(CCCCCC(=O)OCC(CCCCCCCC)CCCCCCCCCC)CCN1CCCC1] | C |
| I-32 | 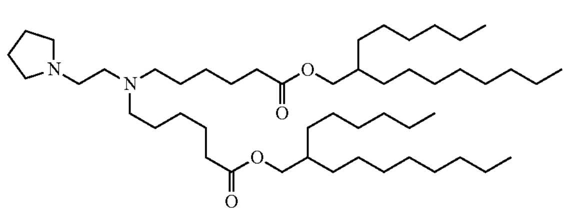 [SMILES: CCCCCCCCC(CCCCCC)COC(=O)CCCCCN(CCCCCC(=O)OCC(CCCCCC)CCCCCCCC)CCN1CCCC1] | C |

TABLE 1-continued
Representative Lipids of Formula (I)
| No. | Structure | Prep. Method |
|---|---|---|
| I-33 | 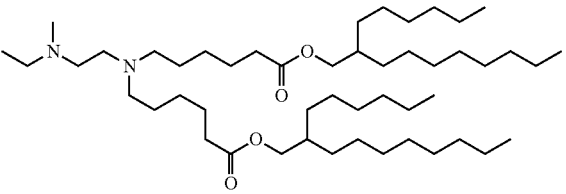 [SMILES: CCCCCCCCC(CCCCCC)COC(=O)CCCCCN(CCCCCC(=O)OCC(CCCCCC)CCCCCCCC)CCN(C)CC] | C |
| I-34 | 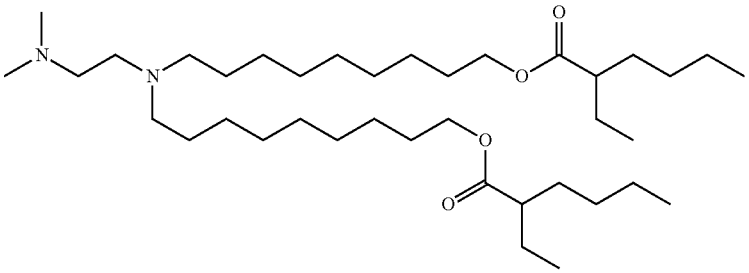 [SMILES: CCCCC(CC)C(=O)OCCCCCCCCCN(CCCCCCCCCOC(=O)C(CC)CCCC)CCN(C)C] | B |
| I-35 | 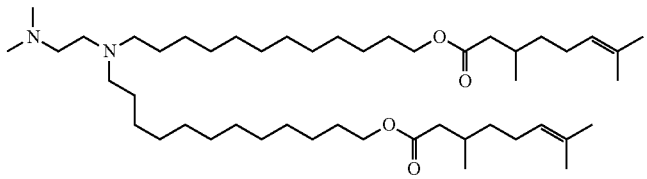 [SMILES: CC(C)=CCCC(C)CC(=O)OCCCCCCCCCCCCN(CCCCCCCCCCCCOC(=O)CC(C)CCC=C(C)C)CCN(C)C] | B |
| I-36 | 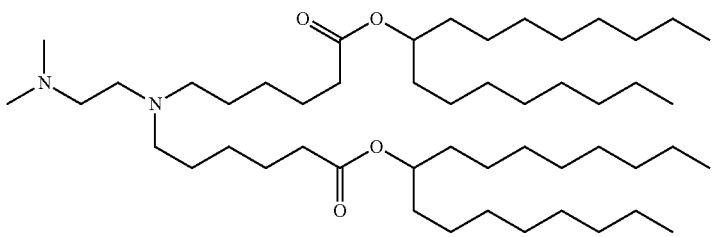 [SMILES: CCCCCCCCC(CCCCCCCC)OC(=O)CCCCCN(CCCCCC(=O)OC(CCCCCCCC)CCCCCCCC)CCN(C)C] | C |
| I-37 | 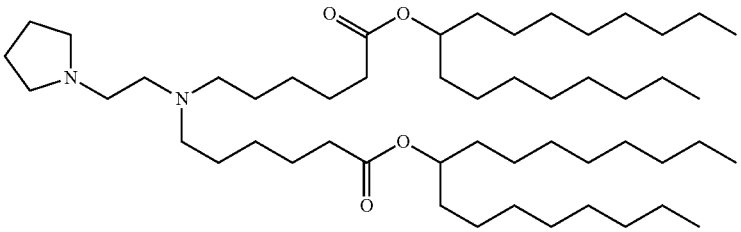 [SMILES: CCCCCCCCC(CCCCCCCC)OC(=O)CCCCCN(CCCCCC(=O)OC(CCCCCCCC)CCCCCCCC)CCN1CCCC1] | C |
| I-38 | 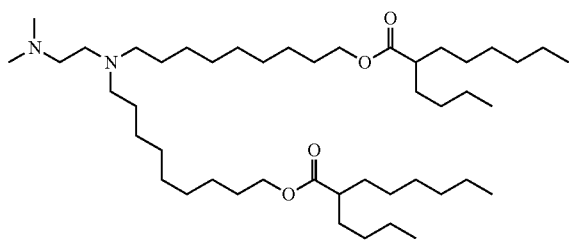 [SMILES: CCCCCCC(CCCC)C(=O)OCCCCCCCCCN(CCCCCCCCCOC(=O)C(CCCC)CCCCCC)CCN(C)C] | B |

TABLE 1-continued

Representative Lipids of Formula (I)

| No. | Structure | Prep. Method |
|---|---|---|
| I-39 | (structure) | B |
| I-40 | (structure) | B |
| I-41 | (structure) | B |

In some embodiments, the LNPs comprise a lipid of Formula (I), a nucleoside-modified RNA and one or more excipients selected from neutral lipids, steroids and pegylated lipids. In some embodiments the lipid of Formula (I) is compound 1-5. In some embodiments the lipid of Formula (I) is compound 1-6.

In some other embodiments, the cationic lipid component of the LNPs has the structure of Formula (II):

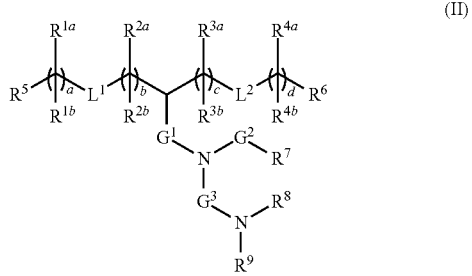

(II)

or a pharmaceutically acceptable salt, tautomer, prodrug or stereoisomer thereof, wherein:

$L^1$ and $L^2$ are each independently —O(C=O)—, —(C=O)O—, —C(=O)—, —O—, —S(O)$_x$—, —S—S—, —C(=O)S—, —SC(=O)—, —NR$^a$C(=O)—, —C(=O)NR$^a$—, —NR$^a$C(=O)NR$^a$, —OC(=O)NR$^a$—, —NR$^a$C(=O)O—, or a direct bond;

$G^1$ is $C_1$-$C_2$ alkylene, —(C=O)—, —O(C=O)—, —SC(=O)—, —NR$^a$C(=O)— or a direct bond;

$G^2$ is —C(=O)—, —(C=O)O—, —C(=O)S—, —C(=O)NR$^a$ or a direct bond;

$G^3$ is $C_1$-$C_6$ alkylene;

$R^a$ is H or $C_1$-$C_{12}$ alkyl;

$R^{1a}$ and $R^{1b}$ are, at each occurrence, independently either: (a) H or $C_1$-$C_{12}$ alkyl; or (b) $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either: (a) H or $C_1$-$C_{12}$ alkyl; or (b) $R^{2a}$ is H or $C_1$-$C_{12}$ alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either: (a) H or $C_1$-$C_{12}$ alkyl; or (b) $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either: (a) H or $C_1$-$C_{12}$ alkyl; or (b) $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently H or methyl;

$R^7$ is $C_4$-$C_{20}$ alkyl;

$R^8$ and $R^9$ are each independently $C_1$-$C_{12}$ alkyl; or $R^8$ and $R^9$, together with the nitrogen atom to which they are attached, form a 5, 6 or 7-membered heterocyclic ring;

a, b, c and d are each independently an integer from 1 to 24; and x is 0, 1 or 2.

In some embodiments of Formula (II), $L^1$ and $L^2$ are each independently —O(C=O)—, —(C=O)O— or a direct bond. In other embodiments, $G^1$ and $G^2$ are each independently —(C=O)— or a direct bond. In some different embodiments, $L^1$ and $L^2$ are each independently —O(C=O)—, —(C=O)O— or a direct bond; and $G^1$ and $G^2$ are each independently —(C=O)— or a direct bond.

In some different embodiments of Formula (II), $L^1$ and $L^2$ are each independently —C(=O)—, —O—, —S(O)$_x$—, —S—S—, —C(=O)S—, —SC(=O)—, —NR$^a$—, —NR$^a$C(=O)—, —C(=O)NR$^a$—, —NR$^a$C(=O)NR$^a$, —OC(=O)NR$^a$—, —NR$^a$C(=O)O—, —NR$^a$S(O)$_x$NR$^a$—, —NR$^a$S(O)$_x$— or —S(O)$_x$NR$^a$—.

In other of the foregoing embodiments of Formula (II), the lipid compound has one of the following structures (IIA) or (IIB):

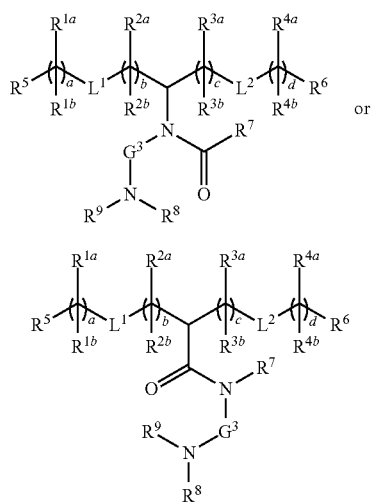

In some embodiments of Formula (II), the lipid compound has structure (IIA). In other embodiments, the lipid compound has structure (IIB).

In any of the foregoing embodiments of Formula (II), one of $L^1$ or $L^2$ is —O(C=O)—. For example, in some embodiments each of $L^1$ and $L^2$ are —O(C=O)—.

In some different embodiments of Formula (II), one of $L^1$ or $L^2$ is —(C=O)O—. For example, in some embodiments each of $L^1$ and $L^2$ is —(C=O)O—.

In different embodiments of Formula (II), one of $L^1$ or $L^2$ is a direct bond. As used herein, a "direct bond" means the group (e.g., $L^1$ or $L^2$) is absent. For example, in some embodiments each of $L^1$ and $L^2$ is a direct bond.

In other different embodiments of Formula (II), for at least one occurrence of $R^{1a}$ and $R^{1b}$, $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond.

In still other different embodiments of Formula (II), for at least one occurrence of $R^{4a}$ and $R^{4b}$, $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond.

In more embodiments of Formula (II), for at least one occurrence of $R^{2a}$ and $R^{2b}$, $R^{2a}$ is H or $C_1$-$C_{12}$ alkyl, and $R^{2b}$ together with the carbon atom to which it is bound is taken together with an adjacent $R^{2b}$ and the carbon atom to which it is bound to form a carbon-carbon double bond.

In other different embodiments of Formula (II), for at least one occurrence of $R^{3a}$ and $R^{3b}$, $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond.

In various other embodiments of Formula (II), the lipid compound has one of the following structures (IIC) or (IID):

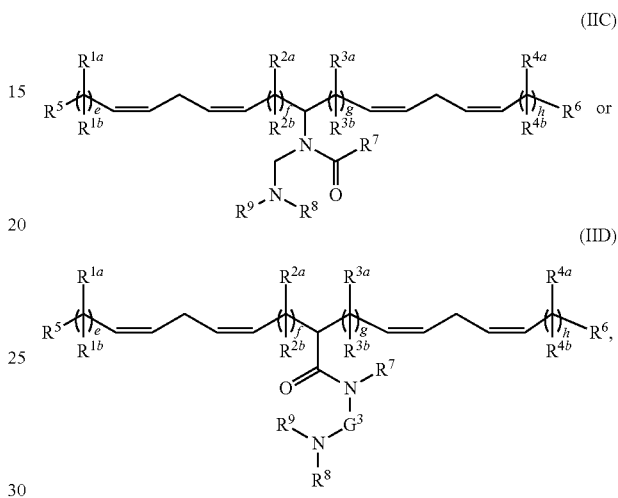

wherein e, f, g and h are each independently an integer from 1 to 12.

In some embodiments of Formula (II), the lipid compound has structure (IIC). In other embodiments, the lipid compound has structure (IID).

In various embodiments of structures (IIC) or (IID), e, f, g and h are each independently an integer from 4 to 10.

In some embodiments of Formula (II), a, b, c and d are each independently an integer from 2 to 12 or an integer from 4 to 12. In other embodiments, a, b, c and d are each independently an integer from 8 to 12 or 5 to 9. In some embodiments, a is 0. In some embodiments, a is 1. In other embodiments, a is 2. In more embodiments, a is 3. In yet other embodiments, a is 4. In some embodiments, a is 5. In other embodiments, a is 6. In more embodiments, a is 7. In yet other embodiments, a is 8. In some embodiments, a is 9. In other embodiments, a is 10. In more embodiments, a is 11. In yet other embodiments, a is 12. In some embodiments, a is 13. In other embodiments, a is 14. In more embodiments, a is 15. In yet other embodiments, a is 16.

In some embodiments of Formula (II), b is 1. In other embodiments, b is 2. In more embodiments, b is 3. In yet other embodiments, b is 4. In some embodiments, b is 5. In other embodiments, b is 6. In more embodiments, b is 7. In yet other embodiments, b is 8. In some embodiments, b is 9. In other embodiments, b is 10. In more embodiments, b is 11. In yet other embodiments, b is 12. In some embodiments, b is 13. In other embodiments, b is 14. In more embodiments, b is 15. In yet other embodiments, b is 16.

In some embodiments of Formula (II), c is 1. In other embodiments, c is 2. In more embodiments, c is 3. In yet other embodiments, c is 4. In some embodiments, c is 5. In other embodiments, c is 6. In more embodiments, c is 7. In yet other embodiments, c is 8. In some embodiments, c is 9. In other embodiments, c is 10. In more embodiments, c is 11. In yet other embodiments, c is 12. In some embodiments, c is 13. In other embodiments, c is 14. In more embodiments, c is 15. In yet other embodiments, c is 16.

In some embodiments of Formula (II), d is 0. In some embodiments, d is 1. In other embodiments, d is 2. In more embodiments, d is 3. In yet other embodiments, d is 4. In some embodiments, d is 5. In other embodiments, d is 6. In more embodiments, d is 7. In yet other embodiments, d is 8. In some embodiments, d is 9. In other embodiments, d is 10. In more embodiments, d is 11. In yet other embodiments, d is 12. In some embodiments, d is 13. In other embodiments, d is 14. In more embodiments, d is 15. In yet other embodiments, d is 16.

In some embodiments of Formula (II), e is 1. In other embodiments, e is 2. In more embodiments, e is 3. In yet other embodiments, e is 4. In some embodiments, e is 5. In other embodiments, e is 6. In more embodiments, e is 7. In yet other embodiments, e is 8. In some embodiments, e is 9. In other embodiments, e is 10. In more embodiments, e is 11. In yet other embodiments, e is 12.

In some embodiments of Formula (II), f is 1. In other embodiments, f is 2. In more embodiments, f is 3. In yet other embodiments, f is 4. In some embodiments, f is 5. In other embodiments, f is 6. In more embodiments, f is 7. In yet other embodiments, f is 8. In some embodiments, f is 9. In other embodiments, f is 10. In more embodiments, f is 11. In yet other embodiments, f is 12.

In some embodiments of Formula (II), g is 1. In other embodiments, g is 2. In more embodiments, g is 3. In yet other embodiments, g is 4. In some embodiments, g is 5. In other embodiments, g is 6. In more embodiments, g is 7. In yet other embodiments, g is 8. In some embodiments, g is 9. In other embodiments, g is 10. In more embodiments, g is 11. In yet other embodiments, g is 12.

In some embodiments of Formula (II), h is 1. In other embodiments, e is 2. In more embodiments, h is 3. In yet other embodiments, h is 4. In some embodiments, e is 5. In other embodiments, h is 6. In more embodiments, h is 7. In yet other embodiments, h is 8. In some embodiments, h is 9. In other embodiments, h is 10. In more embodiments, his 11. In yet other embodiments, his 12.

In some other various embodiments of Formula (II), a and d are the same. In some other embodiments, b and c are the same. In some other specific embodiments and a and d are the same and b and c are the same.

The sum of a and b and the sum of c and d of Formula (II) are factors which may be varied to obtain a lipid having the desired properties. In one embodiment, a and b are chosen such that their sum is an integer ranging from 14 to 24. In other embodiments, c and d are chosen such that their sum is an integer ranging from 14 to 24. In further embodiment, the sum of a and b and the sum of c and d are the same. For example, in some embodiments the sum of a and b and the sum of c and d are both the same integer which may range from 14 to 24. In still more embodiments, a, b, c and d are selected such that the sum of a and b and the sum of c and d is 12 or greater.

The substituents at $R^{1a}$, $R^{2a}$, $R^{3a}$ and $R^{4a}$ of Formula (II) are not particularly limited. In some embodiments, at least one of $R^{1a}$, $R^{2a}$, $R^{3a}$ and $R^{4a}$ is H. In some embodiments $R^{1a}$, $R^{2a}$, $R^{3a}$ and $R^{4a}$ are H at each occurrence. In some other embodiments at least one of $R^{1a}$, $R^{2a}$, $R^{3a}$ and $R^{4a}$ is $C_1$-$C_{12}$ alkyl. In some other embodiments at least one of $R^{1a}$, $R^{2a}$, $R^{3a}$ and $R^{4a}$ is $C_1$-$C_8$ alkyl. In some other embodiments at least one of $R^{1a}$, $R^{2a}$, $R^{3a}$ and $R^{4a}$ is $C_1$-$C_6$ alkyl. In some of the foregoing embodiments, the $C_1$-$C_8$ alkyl is methyl, ethyl, n-propyl, iso-propyl, n-butyl, iso-butyl, tert-butyl, n-hexyl or n-octyl.

In some embodiments of Formula (II), $R^{1a}$, $R^{1b}$, $R^{4a}$ and $R^{4b}$ are $C_1$-$C_{12}$ alkyl at each occurrence.

In further embodiments of Formula (II), at least one of $R^{1b}$, $R^{2b}$, $R^{3b}$ and $R^{4b}$ is H or $R^{1b}$, $R^{2b}$, $R^{3b}$ and $R^{4b}$ are H at each occurrence.

In some embodiments of Formula (II), $R^{1b}$ together with the carbon atom to which it is bound is taken together with an adjacent $R^{1b}$ and the carbon atom to which it is bound to form a carbon-carbon double bond. In other embodiments of the foregoing $R^{4b}$ together with the carbon atom to which it is bound is taken together with an adjacent $R^{4b}$ and the carbon atom to which it is bound to form a carbon-carbon double bond.

The substituents at $R^5$ and $R^6$ of Formula (II) are not particularly limited in the foregoing embodiments. In some embodiments one of $R^5$ or $R^6$ is methyl. In other embodiments each of $R^5$ or $R^6$ is methyl.

The substituents at $R^7$ of Formula (II) are not particularly limited in the foregoing embodiments. In some embodiments $R^7$ is $C_6$-$C_{16}$ alkyl. In some other embodiments, $R^7$ is $C_6$-$C_9$ alkyl. In some of these embodiments, $R^7$ is substituted with —(C=O)OR$^b$, —O(C=O)R$^b$, —C(=O)R$^b$, —OR$^b$, —S(O)$_x$R$^b$, —S—SR$^b$, —C(=O)SR$^b$, —SC(=O)R$^b$, —NR$^a$R$^b$, —NR$^a$C(=O)R$^b$, —C(=O)NR$^a$R$^b$, —NR$^a$C(=O)NR$^a$R$^b$, —OC(=O)NR$^a$R$^b$, —NR$^a$C(=O)OR$^b$, —NR$^a$S(O)$_x$NR$^a$R$^b$, —NR$^a$S(O)$_x$R$^b$ or —S(O)$_x$NR$^a$R$^b$, wherein: $R^a$ is H or $C_1$-$C_{12}$ alkyl; $R^b$ is $C_1$-$C_{15}$ alkyl; and x is 0, 1 or 2. For example, in some embodiments $R^7$ is substituted with —(C=O)OR$^b$ or —O(C=O)R$^b$.

In various of the foregoing embodiments of Formula (II), $R^b$ is branched $C_1$-$C_{15}$ alkyl. For example, in some embodiments $R^b$ has one of the following structures:

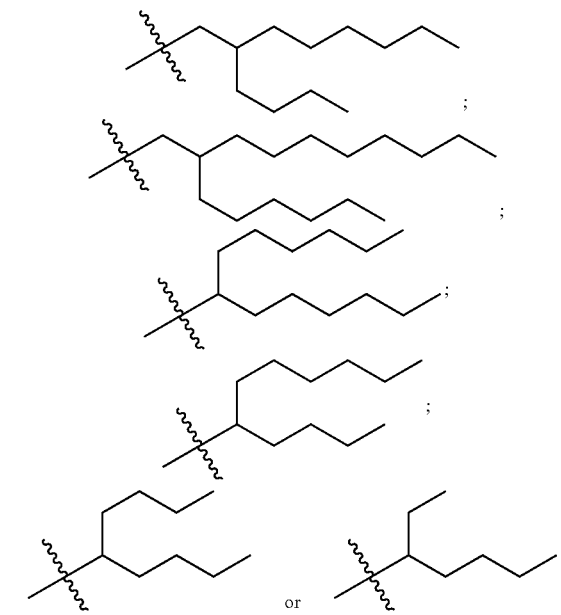

In some other of the foregoing embodiments of Formula (II), one of $R^8$ or $R^9$ is methyl. In other embodiments, both $R^8$ and $R^9$ are methyl.

In some different embodiments of Formula (II), $R^8$ and $R^9$, together with the nitrogen atom to which they are attached, form a 5, 6 or 7-membered heterocyclic ring. In some embodiments of the foregoing, $R^8$ and $R^9$, together with the nitrogen atom to which they are attached, form a 5-membered heterocyclic ring, for example a pyrrolidinyl ring. In some different embodiments of the foregoing, $R^8$ and $R^9$, together with the nitrogen atom to which they are attached, form a 6-membered heterocyclic ring, for example a piperazinyl ring.

In still other embodiments of the foregoing lipids of Formula (II), $G^3$ is $C_2$-$C_4$ alkylene, for example $C_3$ alkylene.

In various different embodiments, the lipid compound has one of the structures set forth in Table 2 below.

TABLE 2

Representative Lipids of Formula (II)

| No. | Structure | Prep. Method |
|---|---|---|
| II-1 | 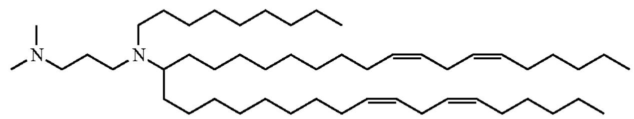 [SMILES: CCCCC/C=C\C/C=C\CCCCCCCCC(CCCCCCCC/C=C\C/C=C\CCCCC)N(CCCCCCCCC)CCCN(C)C] | D |
| II-2 | 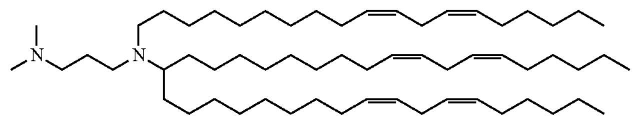 [SMILES: CCCCC/C=C\C/C=C\CCCCCCCCCN(CCCN(C)C)C(CCCCCCCC/C=C\C/C=C\CCCCC)CCCCCCCC/C=C\C/C=C\CCCCC] | D |
| II-3 | 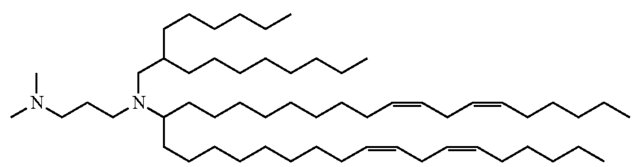 [SMILES: CCCCC/C=C\C/C=C\CCCCCCCCC(CCCCCCCC/C=C\C/C=C\CCCCC)N(CCCN(C)C)CC(CCCCCC)CCCCCCCC] | D |
| II-4 | 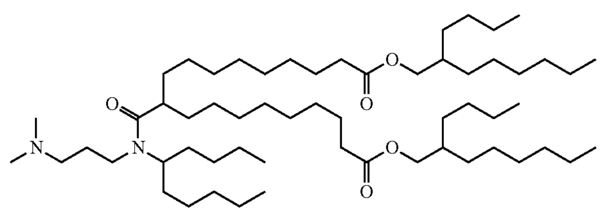 [SMILES: CCCCCCC(CCCC)COC(=O)CCCCCCCCC(CCCCCCCCC(=O)OCC(CCCC)CCCCCC)C(=O)N(CCCN(C)C)C(CCCC)CCCCC] | E |
| II-5 | 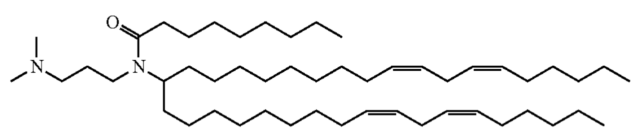 [SMILES: CCCCC/C=C\C/C=C\CCCCCCCCC(CCCCCCCC/C=C\C/C=C\CCCCC)N(CCCN(C)C)C(=O)CCCCCCCC] | D |
| II-6 | 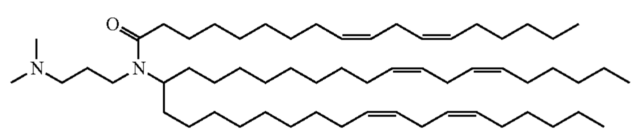 [SMILES: CCCCC/C=C\C/C=C\CCCCCCCCC(CCCCCCCC/C=C\C/C=C\CCCCC)N(CCCN(C)C)C(=O)CCCCCCC/C=C\C/C=C\CCCCC] | D |
| II-7 | 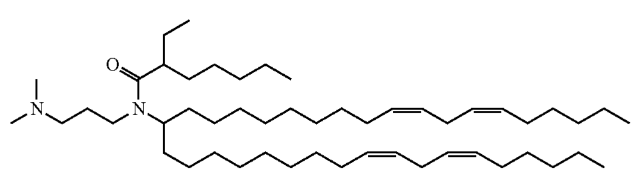 [SMILES: CCCCC/C=C\C/C=C\CCCCCCCCC(CCCCCCCC/C=C\C/C=C\CCCCC)N(CCCN(C)C)C(=O)C(CC)CCCCC] | D |
| II-8 | 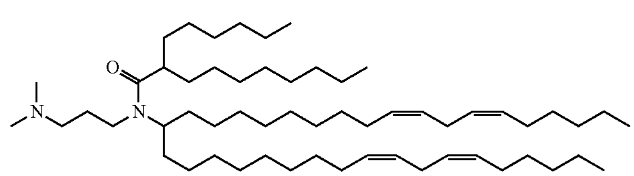 [SMILES: CCCCC/C=C\C/C=C\CCCCCCCCC(CCCCCCCC/C=C\C/C=C\CCCCC)N(CCCN(C)C)C(=O)C(CCCCCC)CCCCCCCC] | D |

TABLE 2-continued

Representative Lipids of Formula (II)

| No. | Structure | Prep. Method |
|---|---|---|
| II-9 | 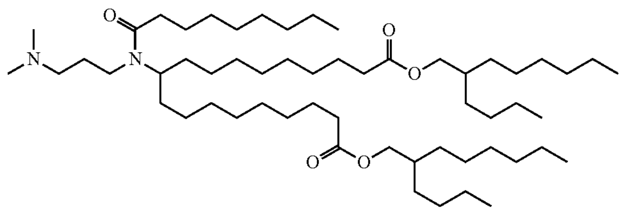 [SMILES: CCCCCCCCC(=O)N(CCCN(C)C)C(CCCCCCCCC(=O)OCC(CCCC)CCCCCC)CCCCCCCCC(=O)OCC(CCCC)CCCCCC] | D |
| II-10 | 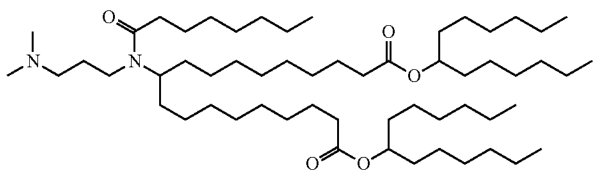 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC] | D |
| II-11 | 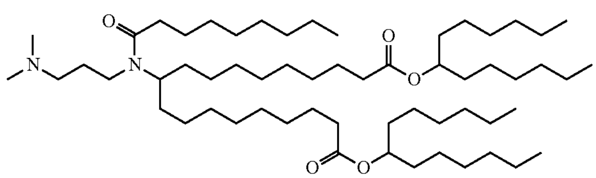 [SMILES: CCCCCCCCC(=O)N(CCCN(C)C)C(CCCCCCCCC(=O)OC(CCCCCC)CCCCCC)CCCCCCCCC(=O)OC(CCCCCC)CCCCCC] | D |
| II-12 | 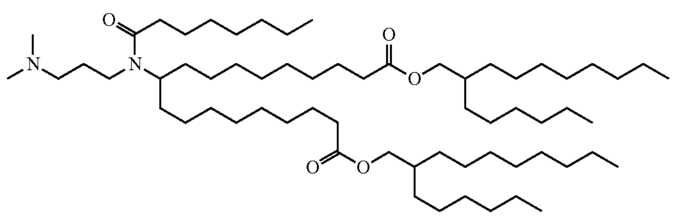 [SMILES: CCCCCCCCC(CCCCCC)COC(=O)CCCCCCCCC(CCCCCCCCC(=O)OCC(CCCCCC)CCCCCCCC)N(CCCN(C)C)C(=O)CCCCCCC] | D |
| II-13 | 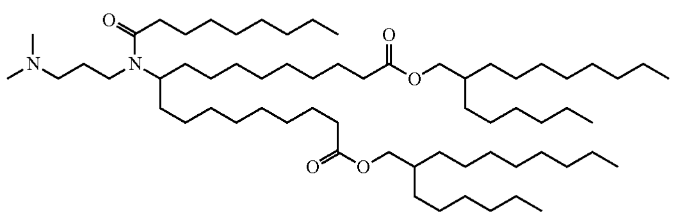 [SMILES: CCCCCCCCC(=O)N(CCCN(C)C)C(CCCCCCCCC(=O)OCC(CCCCCC)CCCCCCCC)CCCCCCCCC(=O)OCC(CCCCCC)CCCCCCCC] | D |
| II-14 | 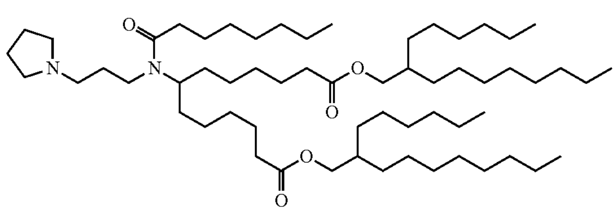 [SMILES: CCCCCCCCC(CCCCCC)COC(=O)CCCCCC(CCCCCC(=O)OCC(CCCCCC)CCCCCCCC)N(CCCN1CCCC1)C(=O)CCCCCCC] | D |
| II-15 | 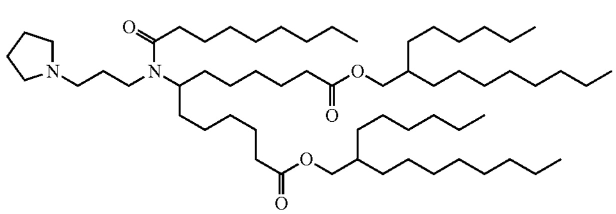 [SMILES: CCCCCCCCC(=O)N(CCCN1CCCC1)C(CCCCCC(=O)OCC(CCCCCC)CCCCCCCC)CCCCCC(=O)OCC(CCCCCC)CCCCCCCC] | D |

TABLE 2-continued
Representative Lipids of Formula (II)
| No. | Structure | Prep. Method |
|---|---|---|
| II-16 | 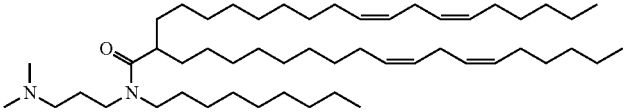 [SMILES: CCCCC/C=C\C/C=C\CCCCCCCCC(CCCCCCCC/C=C\C/C=C\CCCCC)C(=O)N(CCCCCCCCC)CCCN(C)C] | E |
| II-17 | 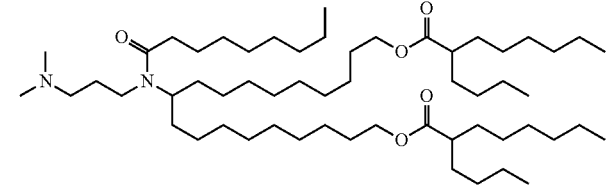 [SMILES: CCCCCCCCC(=O)N(CCCN(C)C)C(CCCCCCCCCOC(=O)C(CCCC)CCCCCC)CCCCCCCCCOC(=O)C(CCCC)CCCCCC] | D |
| II-18 | 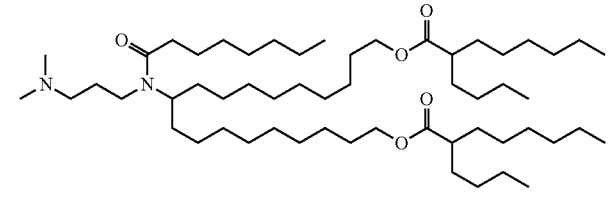 [SMILES: CCCCCCCC(=O)N(CCCN(C)C)C(CCCCCCCCCOC(=O)C(CCCC)CCCCCC)CCCCCCCCCOC(=O)C(CCCC)CCCCCC] | D |
| II-19 | 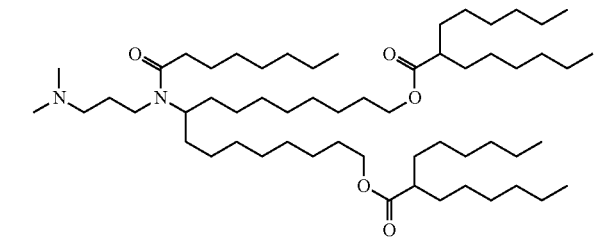 [SMILES: CCCCCCCC(=O)N(CCCN(C)C)C(CCCCCCCCOC(=O)C(CCCCCC)CCCCCC)CCCCCCCCOC(=O)C(CCCCCC)CCCCCC] | D |
| II-20 | 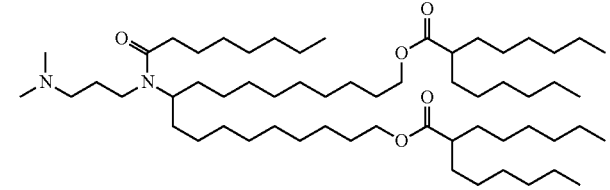 [SMILES: CCCCCCCC(=O)N(CCCN(C)C)C(CCCCCCCCCOC(=O)C(CCCCCC)CCCCCC)CCCCCCCCCOC(=O)C(CCCCCC)CCCCCC] | D |
| II-21 | 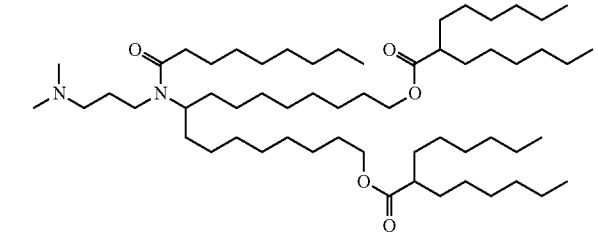 [SMILES: CCCCCCCCC(=O)N(CCCN(C)C)C(CCCCCCCCOC(=O)C(CCCCCC)CCCCCC)CCCCCCCCOC(=O)C(CCCCCC)CCCCCC] | D |
| II-22 | 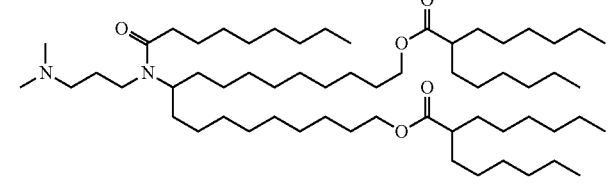 | D |

TABLE 2-continued

Representative Lipids of Formula (II)

| No. | Structure | Prep. Method |
|---|---|---|
| II-23 | 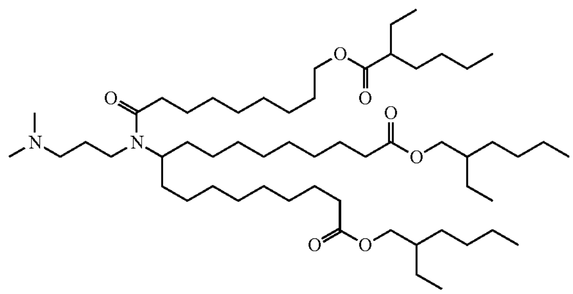 [SMILES: CCCCC(CC)COC(=O)CCCCCCCCC(CCCCCCCCC(=O)OCC(CC)CCCC)N(CCCN(C)C)C(=O)CCCCCCCCOC(=O)C(CC)CCCC] | D |
| II-24 | 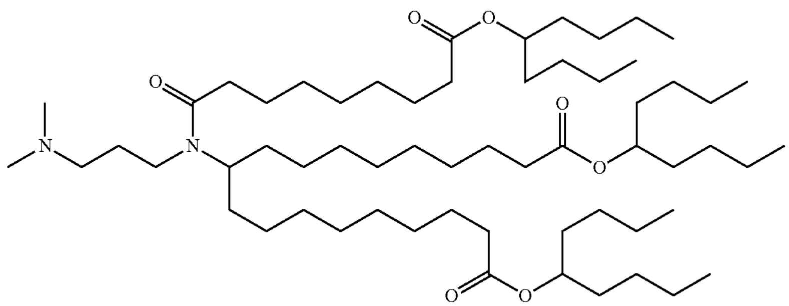 [SMILES: CCCCC(CCCC)OC(=O)CCCCCCCCC(CCCCCCCCC(=O)OC(CCCC)CCCC)N(CCCN(C)C)C(=O)CCCCCCCC(=O)OC(CCCC)CCCC] | D |
| II-25 | 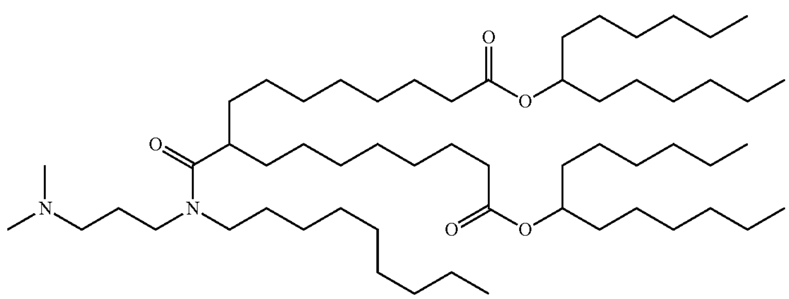 [SMILES: CCCCCCCCCN(CCCN(C)C)C(=O)C(CCCCCCCC(=O)OC(CCCCCC)CCCCCC)CCCCCCCC(=O)OC(CCCCCC)CCCCCC] | E |
| II-26 | 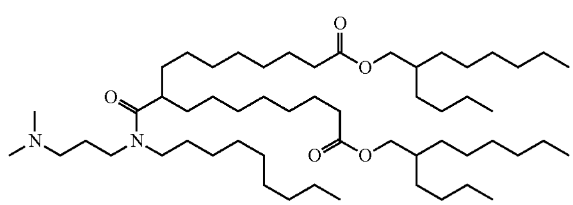 [SMILES: CCCCCCCCCN(CCCN(C)C)C(=O)C(CCCCCCCC(=O)OCC(CCCC)CCCCCC)CCCCCCCC(=O)OCC(CCCC)CCCCCC] | E |
| II-27 | 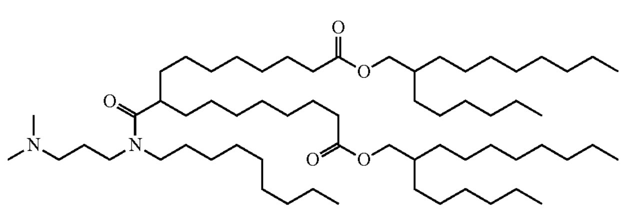 [SMILES: CCCCCCCCCN(CCCN(C)C)C(=O)C(CCCCCCCC(=O)OCC(CCCCCC)CCCCCCCC)CCCCCCCC(=O)OCC(CCCCCC)CCCCCCCC] | E |
| II-28 | 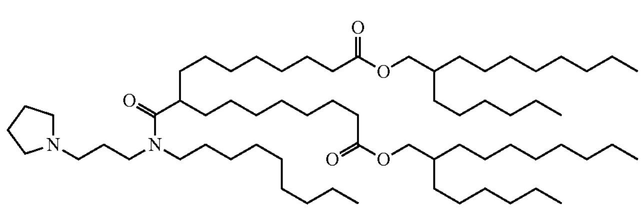 [SMILES: CCCCCCCCCN(CCCN1CCCC1)C(=O)C(CCCCCCCC(=O)OCC(CCCCCC)CCCCCCCC)CCCCCCCC(=O)OCC(CCCCCC)CCCCCCCC] | E |

TABLE 2-continued

Representative Lipids of Formula (II)

| No. | Structure | Prep. Method |
|---|---|---|
| II-29 | 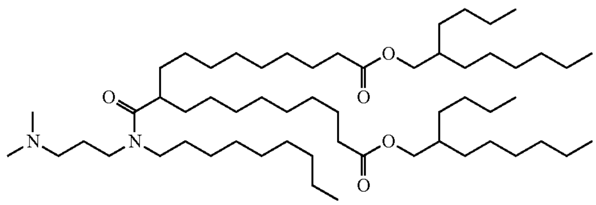 [SMILES: CCCCCCCCCN(CCCN(C)C)C(=O)C(CCCCCCCCC(=O)OCC(CCCC)CCCCCC)CCCCCCCCC(=O)OCC(CCCC)CCCCCC] | E |
| II-30 | 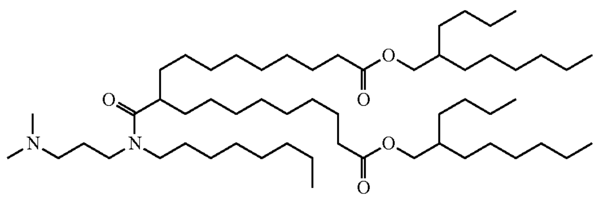 [SMILES: CCCCCCCCN(CCCN(C)C)C(=O)C(CCCCCCCCC(=O)OCC(CCCC)CCCCCC)CCCCCCCCC(=O)OCC(CCCC)CCCCCC] | E |
| II-31 | 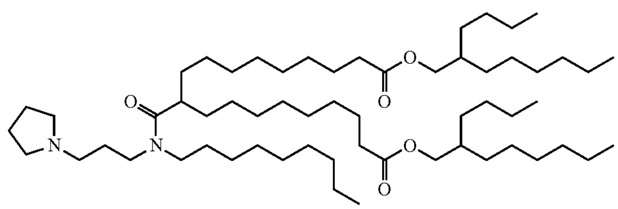 [SMILES: CCCCCCCCCN(CCCN1CCCC1)C(=O)C(CCCCCCCCC(=O)OCC(CCCC)CCCCCC)CCCCCCCCC(=O)OCC(CCCC)CCCCCC] | E |
| II-32 | 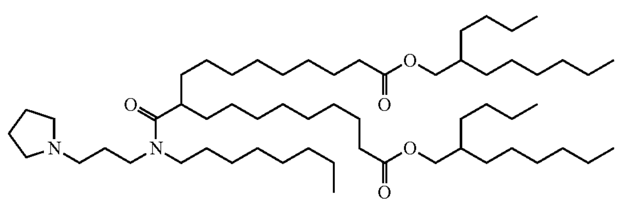 [SMILES: CCCCCCCCN(CCCN1CCCC1)C(=O)C(CCCCCCCCC(=O)OCC(CCCC)CCCCCC)CCCCCCCCC(=O)OCC(CCCC)CCCCCC] | E |
| II-33 | 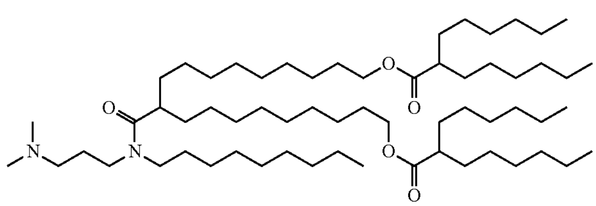 [SMILES: CCCCCCCCCN(CCCN(C)C)C(=O)C(CCCCCCCCCOC(=O)C(CCCCCC)CCCCCC)CCCCCCCCCOC(=O)C(CCCCCC)CCCCCC] | E |
| II-34 | 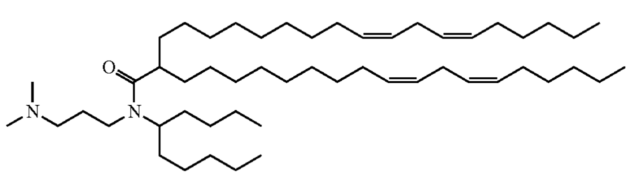 [SMILES: CCCCC/C=C\C/C=C\CCCCCCCCC(CCCCCCCC/C=C\C/C=C\CCCCC)C(=O)N(CCCN(C)C)C(CCCC)CCCCC] | E |
| II-35 | 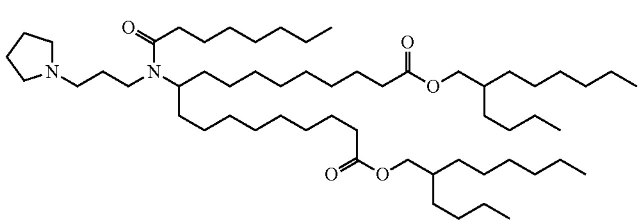 [SMILES: CCCCCCCC(=O)N(CCCN1CCCC1)C(CCCCCCCCC(=O)OCC(CCCC)CCCCCC)CCCCCCCCC(=O)OCC(CCCC)CCCCCC] | D |

TABLE 2-continued

Representative Lipids of Formula (II)

| No. | Structure | Prep. Method |
|---|---|---|
| II-36 | 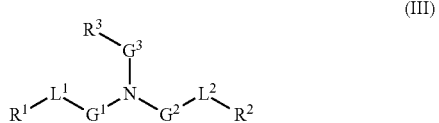 | D |

In some embodiments, the LNPs comprise a lipid of Formula (II), a nucleoside-modified RNA and one or more excipient selected from neutral lipids, steroids and pegylated lipids. In some embodiments the lipid of Formula (II) is compound II-9. In some embodiments the lipid of Formula (II) is compound II-10. In some embodiments the lipid of Formula (II) is compound II-11. In some embodiments the lipid of Formula (II) is compound II-12. In some embodiments the lipid of Formula (II) is compound II-32.

In some other embodiments, the cationic lipid component of the LNPs has the structure of Formula (III):

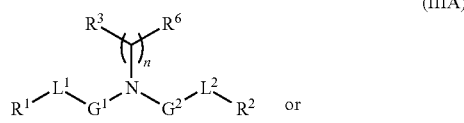
(III)

or a pharmaceutically acceptable salt, tautomer, prodrug or stereoisomer thereof, wherein:

one of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O— or a direct bond;

$G^1$ and $G^2$ are each independently unsubstituted $C_1$-$C_{12}$ alkylene or $C_1$-$C_{12}$ alkenylene;

$G^3$ is $C_1$-$C_{24}$ alkylene, $C_1$-$C_{24}$ alkenylene, $C_3$-$C_8$ cycloalkylene, $C_3$-$C_8$ cycloalkenylene;

$R^a$ is H or $C_1$-$C_{12}$ alkyl;

$R^1$ and $R^2$ are each independently $C_6$-$C_{24}$ alkyl or $C_6$-$C_{24}$ alkenyl;

$R^3$ is H, OR$^5$, CN, —C(=O)OR$^4$, —OC(=O)R$^4$ or —NR$^5$C(=O)R$^4$;

$R^4$ is $C_1$-$C_{12}$ alkyl;

$R^5$ is H or $C_1$-$C_6$ alkyl; and x is 0, 1 or 2.

In some of the foregoing embodiments of Formula (III), the lipid has one of the following structures (IIIA) or (IIIB):

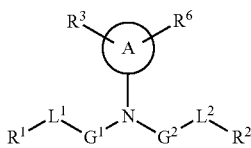
(IIIA)

(IIIB)

wherein:

A is a 3 to 8-membered cycloalkyl or cycloalkylene ring;

$R^6$ is, at each occurrence, independently H, OH or $C_1$-$C_{24}$ alkyl;

n is an integer ranging from 1 to 15.

In some of the foregoing embodiments of Formula (III), the lipid has structure (IIIA), and in other embodiments, the lipid has structure (IIIB).

In other embodiments of Formula (III), the lipid has one of the following structures (IIIC) or (IIID):

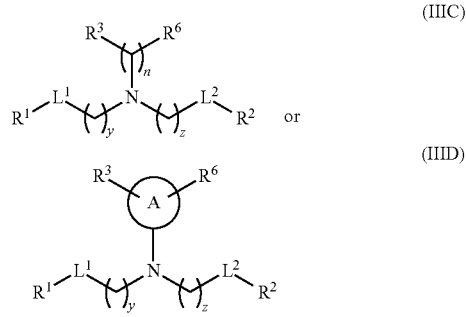
(IIIC)

(IIID)

wherein y and z are each independently integers ranging from 1 to 12.

In any of the foregoing embodiments of Formula (III), one of $L^1$ or $L^2$ is —O(C=O)—. For example, in some embodiments each of $L^1$ and $L^2$ are —O(C=O)—. In some different embodiments of any of the foregoing, $L^1$ and $L^2$ are each independently —(C=O)O— or —O(C=O)—. For example, in some embodiments each of $L^1$ and $L^2$ is —(C=O)O—.

In some different embodiments of Formula (III), the lipid has one of the following structures (IIIE) or (IIIF):

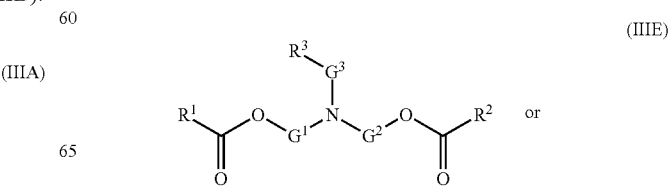
(IIIE)

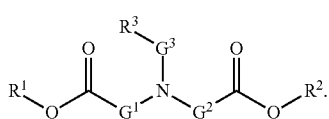 (IIIF)

In some of the foregoing embodiments of Formula (III), the lipid has one of the following structures (IIIG), (IIIH), (IIII), or (IIIJ):

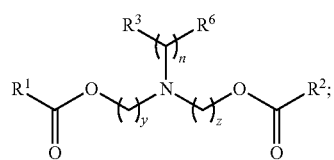 (IIIG)

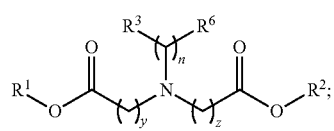 (IIIH)

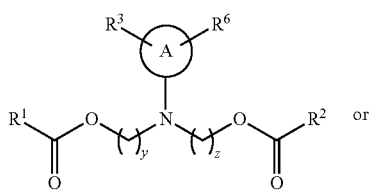 (IIII)

or

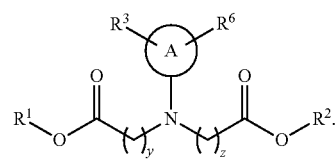 (IIIJ)

In some of the foregoing embodiments of Formula (III), n is an integer ranging from 2 to 12, for example from 2 to 8 or from 2 to 4. For example, in some embodiments, n is 3, 4, 5 or 6. In some embodiments, n is 3. In some embodiments, n is 4. In some embodiments, n is 5. In some embodiments, n is 6.

In some other of the foregoing embodiments of Formula (III), y and z are each independently an integer ranging from 2 to 10. For example, in some embodiments, y and z are each independently an integer ranging from 4 to 9 or from 4 to 6.

In some of the foregoing embodiments of Formula (III), $R^6$ is H. In other of the foregoing embodiments, $R^6$ is $C_1$-$C_{24}$ alkyl. In other embodiments, $R^6$ is OH.

In some embodiments of Formula (III), $G^3$ is unsubstituted. In other embodiments, G3 is substituted. In various different embodiments, $G^3$ is linear $C_1$-$C_{24}$ alkylene or linear $C_1$-$C_{24}$ alkenylene.

In some other foregoing embodiments of Formula (III), $R^1$ or $R^2$, or both, is $C_6$-$C_{24}$ alkenyl. For example, in some embodiments, $R^1$ and $R^2$ each, independently have the following structure:

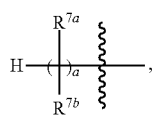

wherein:
$R^{7a}$ and $R^{7b}$ are, at each occurrence, independently H or $C_1$-$C_{12}$ alkyl; and
a is an integer from 2 to 12,
wherein $R^{7a}$, $R^{7b}$ and a are each selected such that $R^1$ and $R^2$ each independently comprise from 6 to 20 carbon atoms. For example, in some embodiments a is an integer ranging from 5 to 9 or from 8 to 12.

In some of the foregoing embodiments of Formula (III), at least one occurrence of $R^{7a}$ is H. For example, in some embodiments, $R^{7a}$ is H at each occurrence. In other different embodiments of the foregoing, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In different embodiments of Formula (III), $R^1$ or $R^2$, or both, has one of the following structures:

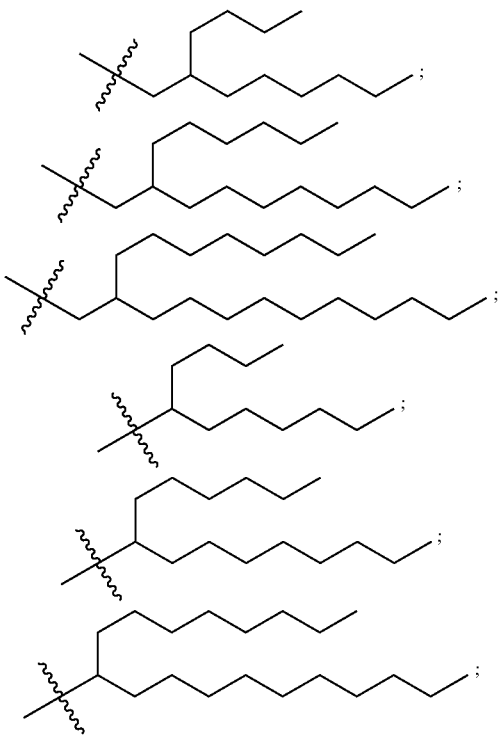

In some of the foregoing embodiments of Formula (III), $R^3$ is OH, CN, —C(=O)OR$^4$, —OC(=O)R$^4$ or —NHC(=O)R$^4$. In some embodiments, R$^4$ is methyl or ethyl.

In various different embodiments, the cationic lipid of Formula (III) has one of the structures set forth in Table 3 below.

TABLE 3

Representative Compounds of Formula (III)

| No. | Structure | Prep. Method |
|---|---|---|
| III-1 | 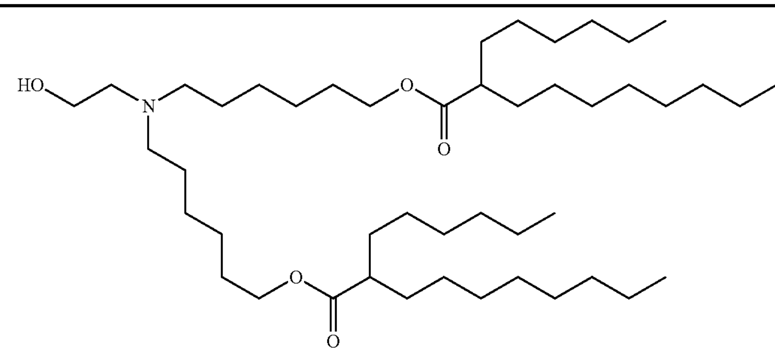 | F |
| III-2 | 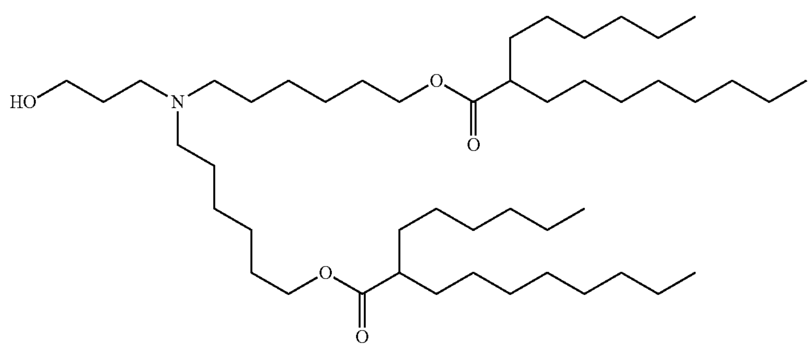 [SMILES: CCCCCCCCC(CCCCCC)C(=O)OCCCCCCN(CCCO)CCCCCCOC(=O)C(CCCCCC)CCCCCCCC] | F |
| III-3 | 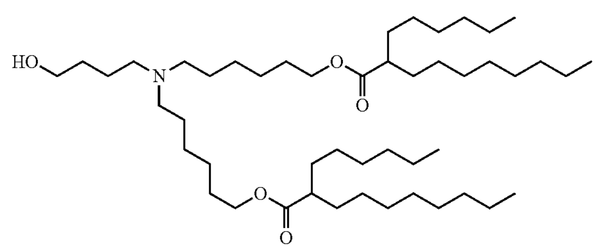 [SMILES: CCCCCCCCC(CCCCCC)C(=O)OCCCCCCN(CCCCO)CCCCCCOC(=O)C(CCCCCC)CCCCCCCC] | F |
| III-4 | 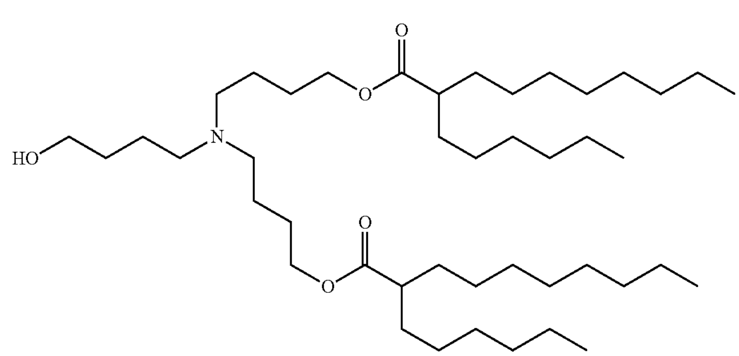 [SMILES: CCCCCCCCC(CCCCCC)C(=O)OCCCCN(CCCCO)CCCCOC(=O)C(CCCCCC)CCCCCCCC] | F |

TABLE 3-continued

Representative Compounds of Formula (III)

| No. | Structure | Prep. Method |
|---|---|---|
| III-5 | 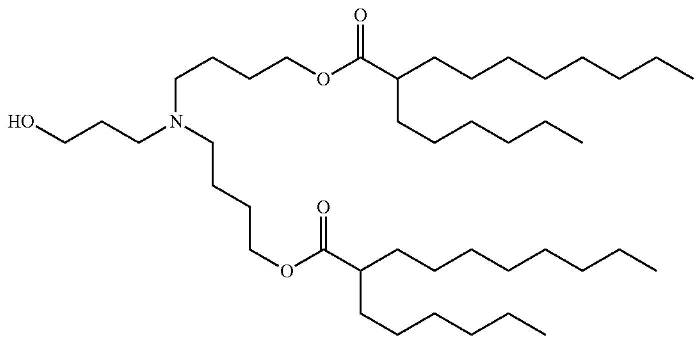 [SMILES: CCCCCCCCC(CCCCCC)C(=O)OCCCCN(CCCO)CCCCOC(=O)C(CCCCCC)CCCCCCCC] | F |
| III-6 | 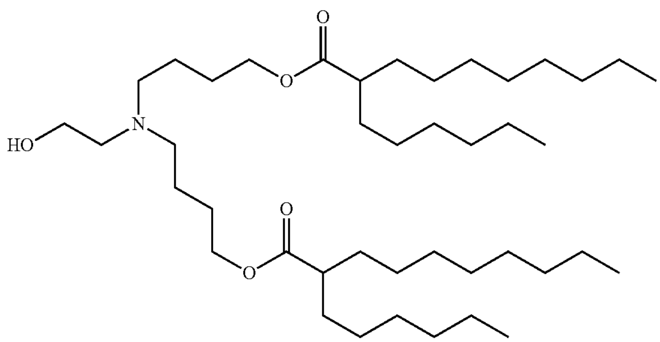 [SMILES: CCCCCCCCC(CCCCCC)C(=O)OCCCCN(CCO)CCCCOC(=O)C(CCCCCC)CCCCCCCC] | F |
| III-7 | 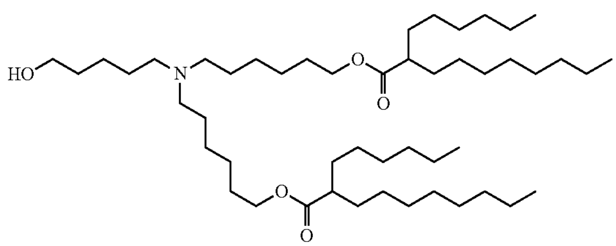 [SMILES: CCCCCCCCC(CCCCCC)C(=O)OCCCCCCN(CCCCCO)CCCCCCOC(=O)C(CCCCCC)CCCCCCCC] | F |
| III-8 | 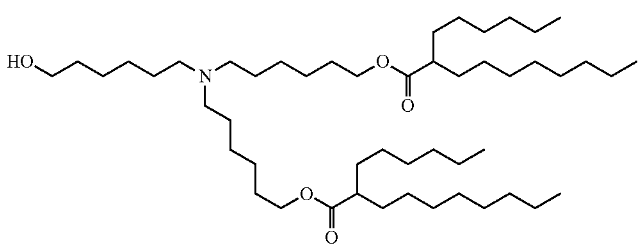 [SMILES: CCCCCCCCC(CCCCCC)C(=O)OCCCCCCN(CCCCCCO)CCCCCCOC(=O)C(CCCCCC)CCCCCCCC] | F |
| III-9 | 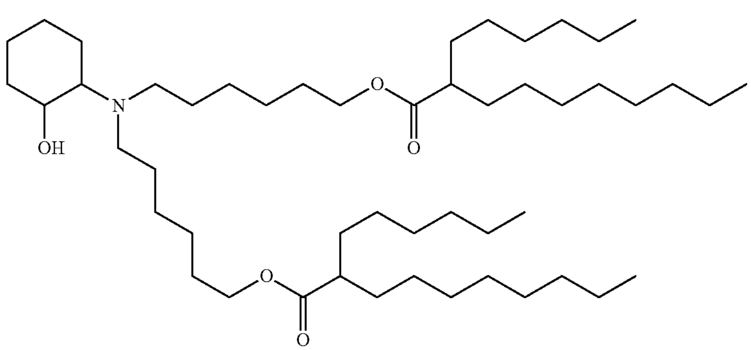 [SMILES: CCCCCCCCC(CCCCCC)C(=O)OCCCCCCN(CCCCCCOC(=O)C(CCCCCC)CCCCCCCC)C1CCCCC1O] | F |

TABLE 3-continued

Representative Compounds of Formula (III)

| No. | Structure | Prep. Method |
|-----|-----------|--------------|
| III-10 | 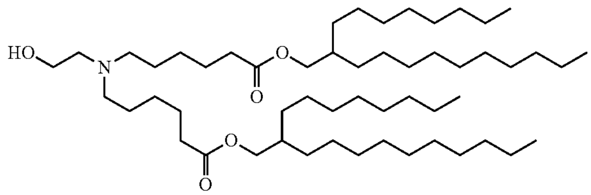 [SMILES: CCCCCCCCCCC(CCCCCCCC)COC(=O)CCCCCN(CCO)CCCCCC(=O)OCC(CCCCCCCC)CCCCCCCCCC] | F |
| III-11 | 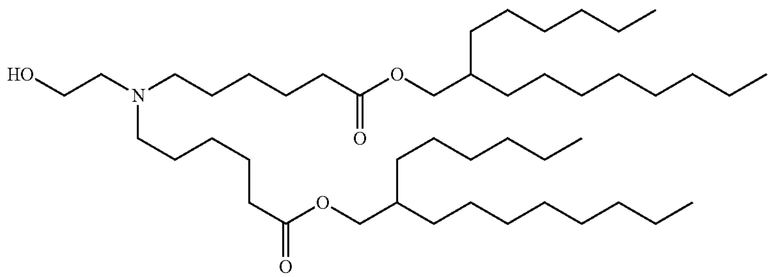 [SMILES: CCCCCCCCC(CCCCCC)COC(=O)CCCCCN(CCO)CCCCCC(=O)OCC(CCCCCC)CCCCCCCC] | F |
| III-12 | 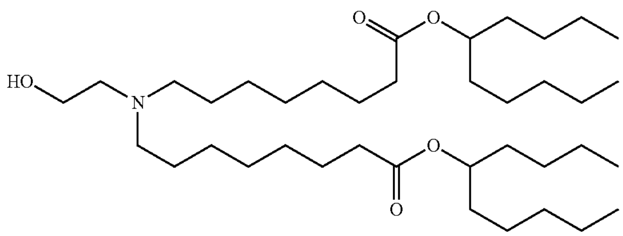 [SMILES: CCCCCC(CCCC)OC(=O)CCCCCCCN(CCO)CCCCCCCC(=O)OC(CCCC)CCCCC] | F |
| III-13 | 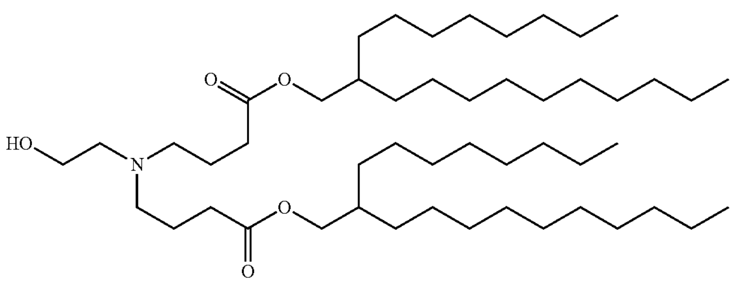 [SMILES: CCCCCCCCCCC(CCCCCCCC)COC(=O)CCCN(CCO)CCCC(=O)OCC(CCCCCCCC)CCCCCCCCCC] | F |
| III-14 | 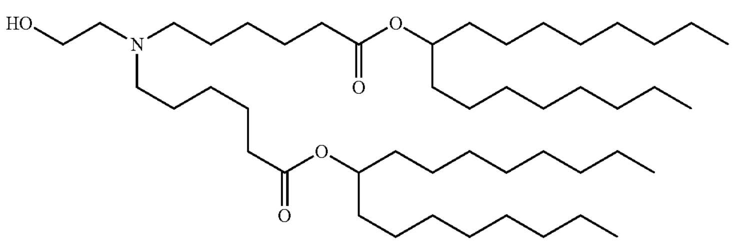 [SMILES: CCCCCCCCC(CCCCCCCC)OC(=O)CCCCCN(CCO)CCCCCC(=O)OC(CCCCCCCC)CCCCCCCC] | F |
| III-15 | 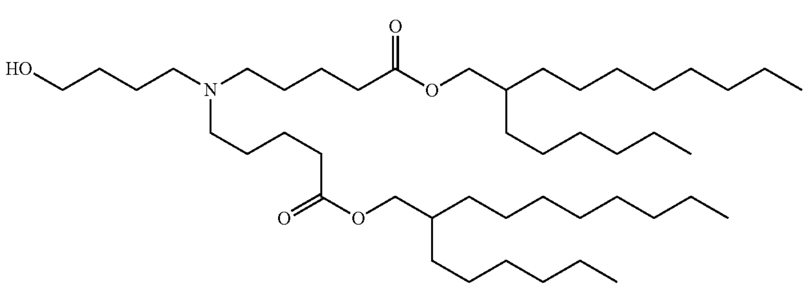 [SMILES: CCCCCCCCC(CCCCCC)COC(=O)CCCCN(CCCCO)CCCCC(=O)OCC(CCCCCC)CCCCCCCC] | F |

TABLE 3-continued
Representative Compounds of Formula (III)
| No. | Structure | Prep. Method |
|---|---|---|
| III-16 | 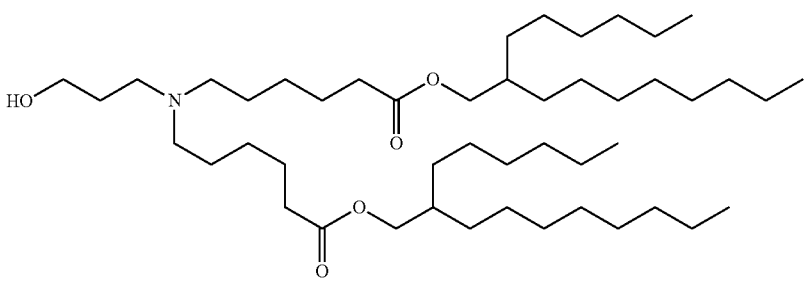 [SMILES: CCCCCCCCC(CCCCCC)COC(=O)CCCCCN(CCCO)CCCCCC(=O)OCC(CCCCCC)CCCCCCCC] | F |
| III-17 | 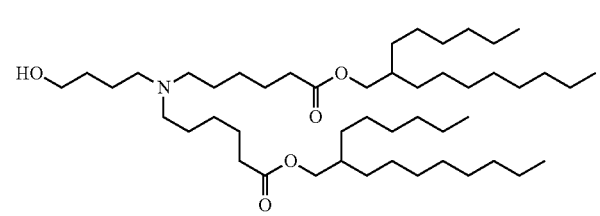 [SMILES: CCCCCCCCC(CCCCCC)COC(=O)CCCCCN(CCCCO)CCCCCC(=O)OCC(CCCCCC)CCCCCCCC] | F |
| III-18 | 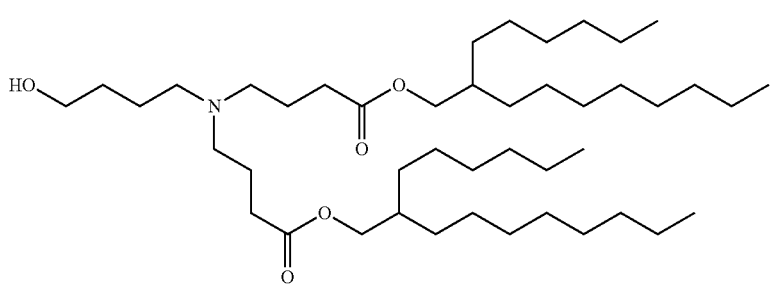 [SMILES: CCCCCCCCC(CCCCCC)COC(=O)CCCN(CCCCO)CCCC(=O)OCC(CCCCCC)CCCCCCCC] | F |
| III-19 | 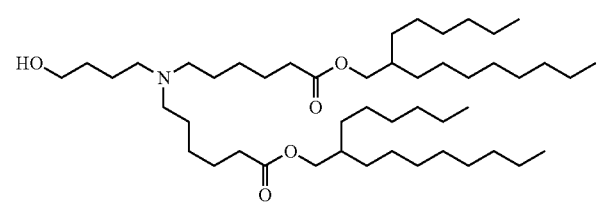 [SMILES: CCCCCCCCC(CCCCCC)COC(=O)CCCCCN(CCCCO)CCCCCC(=O)OCC(CCCCCC)CCCCCCCC] | F |
| III-20 | 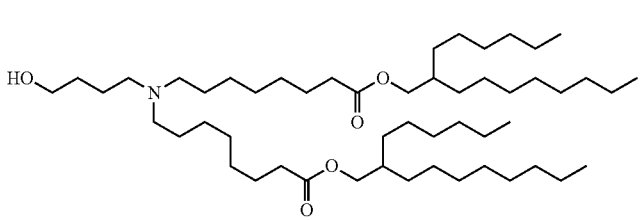 [SMILES: CCCCCCCCC(CCCCCC)COC(=O)CCCCCCCN(CCCCO)CCCCCCCC(=O)OCC(CCCCCC)CCCCCCCC] | F |
| III-21 | 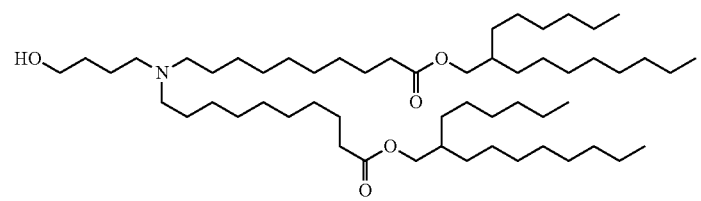 [SMILES: CCCCCCCCC(CCCCCC)COC(=O)CCCCCCCCCN(CCCCO)CCCCCCCCCC(=O)OCC(CCCCCC)CCCCCCCC] | F |

TABLE 3-continued
Representative Compounds of Formula (III)
| No. | Structure | Prep. Method |
|---|---|---|
| III-22 | 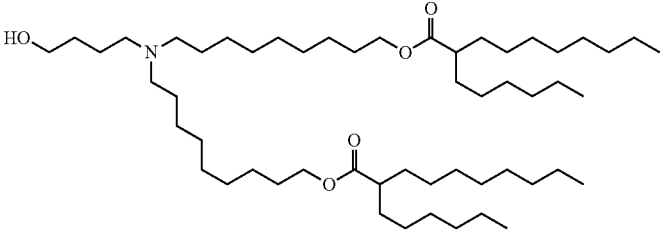 [SMILES: CCCCCCCCC(CCCCCC)C(=O)OCCCCCCCCCN(CCCCO)CCCCCCCCCOC(=O)C(CCCCCC)CCCCCCCC] | F |
| III-23 | 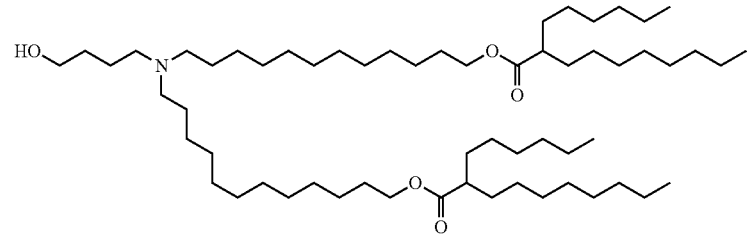 [SMILES: CCCCCCCCC(CCCCCC)C(=O)OCCCCCCCCCCCCN(CCCCO)CCCCCCCCCCCCOC(=O)C(CCCCCC)CCCCCCCC] | F |
| III-24 | 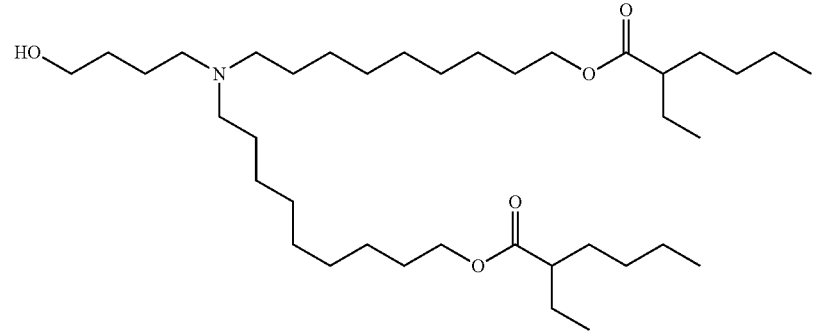 [SMILES: CCCCC(CC)C(=O)OCCCCCCCCCN(CCCCO)CCCCCCCCCOC(=O)C(CC)CCCC] | F |
| III-25 | 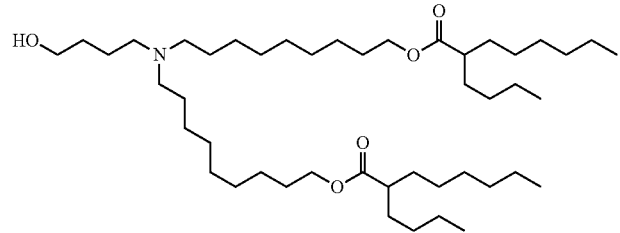 [SMILES: CCCCCCC(CCCC)C(=O)OCCCCCCCCCN(CCCCO)CCCCCCCCCOC(=O)C(CCCC)CCCCCC] | F |
| III-26 | 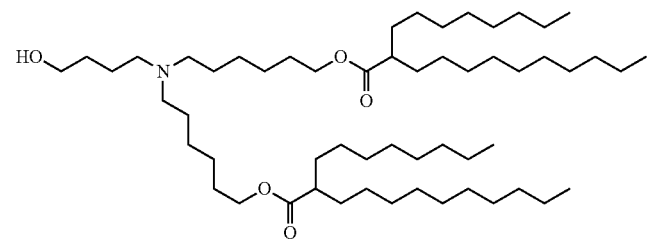 [SMILES: CCCCCCCCCCC(CCCCCCCC)C(=O)OCCCCCCN(CCCCO)CCCCCCOC(=O)C(CCCCCCCC)CCCCCCCCCC] | F |

TABLE 3-continued

Representative Compounds of Formula (III)

| No. | Structure | Prep. Method |
|---|---|---|
| III-27 | 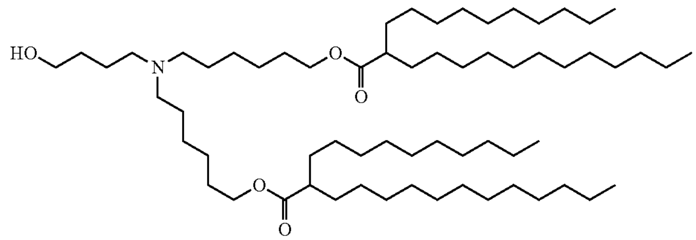 [SMILES: CCCCCCCCCCCCC(CCCCCCCCCC)C(=O)OCCCCCCN(CCCCO)CCCCCCOC(=O)C(CCCCCCCCCC)CCCCCCCCCCCC] | F |
| III-28 | 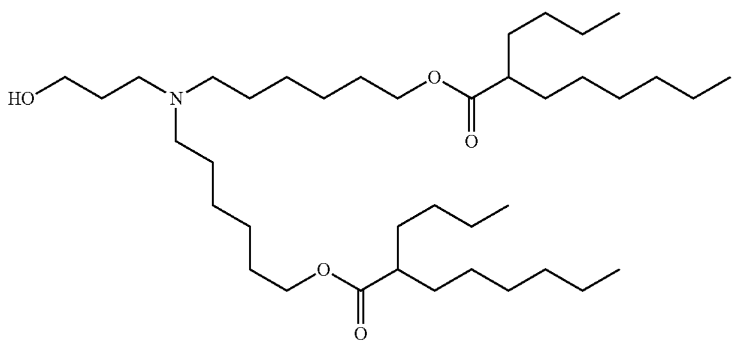 [SMILES: CCCCCCC(CCCC)C(=O)OCCCCCCN(CCCO)CCCCCCOC(=O)C(CCCC)CCCCCC] | F |
| III-29 | 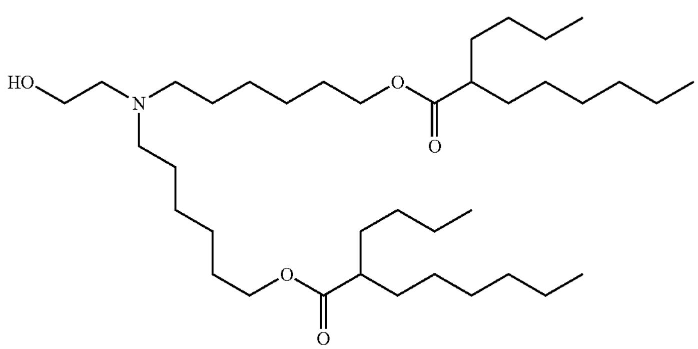 [SMILES: CCCCCCC(CCCC)C(=O)OCCCCCCN(CCO)CCCCCCOC(=O)C(CCCC)CCCCCC] | F |
| III-30 | 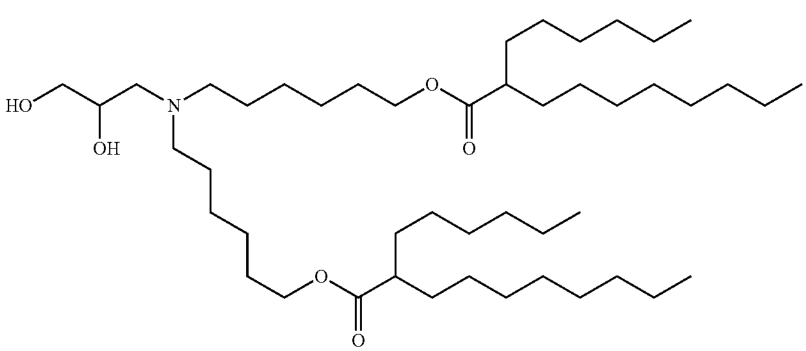 [SMILES: CCCCCCCCC(CCCCCC)C(=O)OCCCCCCN(CCCCCCOC(=O)C(CCCCCC)CCCCCCCC)CC(O)CO] | F |

TABLE 3-continued

Representative Compounds of Formula (III)

| No. | Structure | Prep. Method |
|---|---|---|
| III-31 | 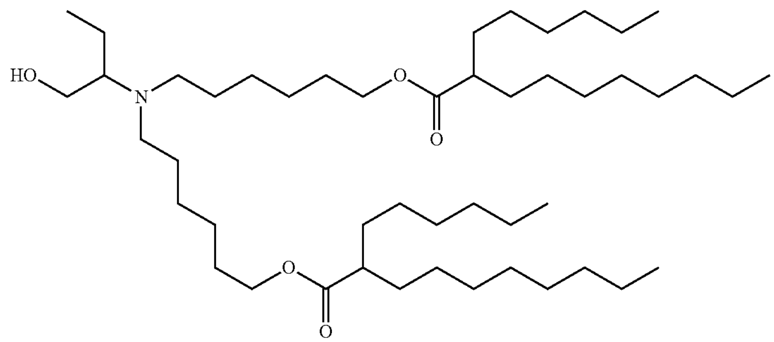 [SMILES: CCCCCCCCC(CCCCCC)C(=O)OCCCCCCN(CCCCCCOC(=O)C(CCCCCC)CCCCCCCC)C(CC)CO] | F |
| III-32 | 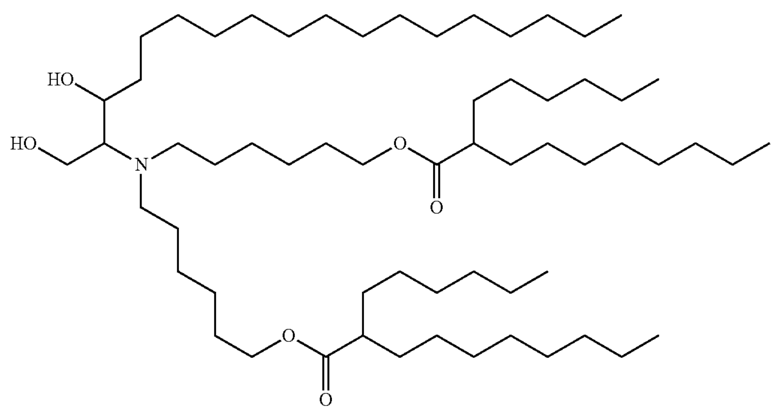 [SMILES: CCCCCCCCCCCCCCCC(O)C(CO)N(CCCCCCOC(=O)C(CCCCCC)CCCCCCCC)CCCCCCOC(=O)C(CCCCCC)CCCCCCCC] | F |
| III-33 | 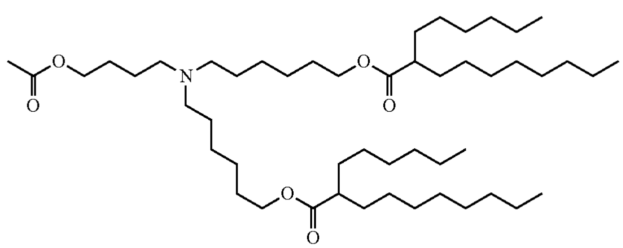 [SMILES: CCCCCCCCC(CCCCCC)C(=O)OCCCCCCN(CCCCCCOC(=O)C(CCCCCC)CCCCCCCC)CCCCOC(C)=O] | F |
| III-34 | 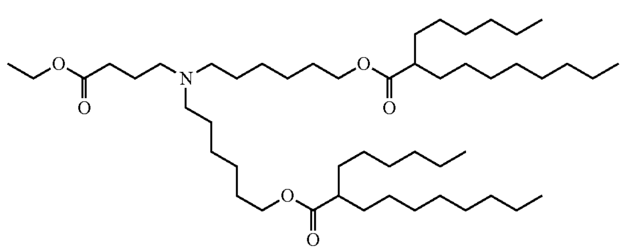 [SMILES: CCCCCCCCC(CCCCCC)C(=O)OCCCCCCN(CCCCCCOC(=O)C(CCCCCC)CCCCCCCC)CCCC(=O)OCC] | F |
| III-35 | 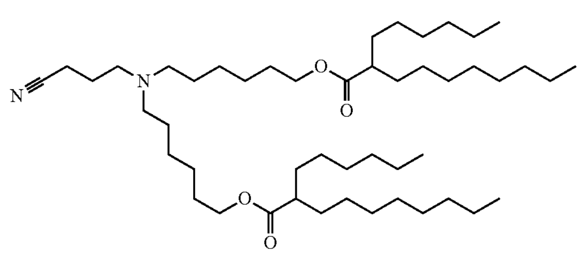 [SMILES: CCCCCCCCC(CCCCCC)C(=O)OCCCCCCN(CCCC#N)CCCCCCOC(=O)C(CCCCCC)CCCCCCCC] | F |

TABLE 3-continued

Representative Compounds of Formula (III)

| No. | Structure | Prep. Method |
|---|---|---|
| III-36 | 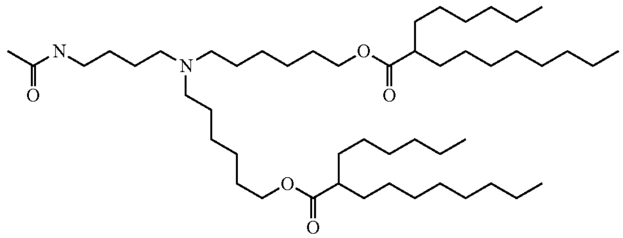 | F |

In some embodiments, the LNPs comprise a lipid of Formula (III), a nucleoside-modified RNA and one or more excipient selected from neutral lipids, steroids and pegylated lipids. In some embodiments the lipid of Formula (III) is compound III-3. In some embodiments the lipid of Formula (III) is compound III-7.

In some embodiments, the cationic lipid is present in the LNP in an amount from about 30 to about 95 mole percent. In one embodiment, the cationic lipid is present in the LNP in an amount from about 30 to about 70 mole percent. In one embodiment, the cationic lipid is present in the LNP in an amount from about 40 to about 60 mole percent. In one embodiment, the cationic lipid is present in the LNP in an amount of about 50 mole percent. In one embodiment, the LNP comprises only cationic lipids.

In some embodiments, the LNP comprises one or more additional lipids which stabilize the formation of particles during their formation.

Suitable stabilizing lipids include neutral lipids and anionic lipids.

The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

Exemplary neutral lipids include, for example, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoyl-phosphatidyethanol amine (SOPE), and 1,2-dielaidoyl-sn-glycero-3-phophoethanolamine (transDOPE). In one embodiment, the neutral lipid is 1,2-distearoyl-sn-glycero-3-phosphocholine (DSPC).

In some embodiments, the LNPs comprise a neutral lipid selected from DSPC, DPPC, DMPC, DOPC, POPC, DOPE and SM. In various embodiments, the molar ratio of the cationic lipid (e.g., lipid of Formula (I)) to the neutral lipid ranges from about 2:1 to about 8:1.

In various embodiments, the LNPs further comprise a steroid or steroid analogue. A "steroid" is a compound comprising the following carbon skeleton:

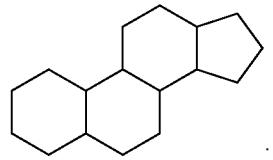 [SMILES: C1CCC2C(C1)CCC1C3CCCC3CCC21]

In some embodiments, the steroid or steroid analogue is cholesterol. In some of these embodiments, the molar ratio of the cationic lipid (e.g., lipid of Formula (I)) to cholesterol ranges from about 2:1 to 1:1.

The term "anionic lipid" refers to any lipid that is negatively charged at physiological pH. These lipids include phosphatidylglycerol, cardiolipin, diacylphosphatidylserine, diacylphosphatidic acid, N-dodecanoylphosphatidylethanolamines, N-succinylphosphatidylethanolamines, N-glutarylphosphatidylethanolamines, lysylphosphatidylglycerols, palmitoyloleyolphosphatidylglycerol (POPG), and other anionic modifying groups joined to neutral lipids.

In some embodiments, the LNP comprises glycolipids (e.g., monosialoganglioside $GM_1$). In some embodiments, the LNP comprises a sterol, such as cholesterol.

In some embodiments, the LNPs comprise a polymer conjugated lipid. The term "polymer conjugated lipid" refers to a molecule comprising both a lipid portion and a polymer portion. An example of a polymer conjugated lipid is a pegylated lipid. The term "pegylated lipid" refers to a molecule comprising both a lipid portion and a polyethylene glycol portion. Pegylated lipids are known in the art and include 1-(monomethoxy-polyethyleneglycol)-2,3-dimyristoylglycerol (PEG-s-DMG) and the like.

In some embodiments, the LNP comprises an additional, stabilizing-lipid which is a polyethylene glycol-lipid (pegylated lipid). Suitable polyethylene glycol-lipids include PEG-modified phosphatidylethanolamine, PEG-modified phosphatidic acid, PEG-modified ceramides (e.g., PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)$_{2000}$)carbamyl]-1,2-dimyristyloxlpropyl-3-amine (PEG-c-DMA). In one embodiment, the polyethylene glycol-lipid is PEG-c-DOMG). In other embodiments, the LNPs comprise a pegylated diacylglycerol (PEG- DAG) such as 1-(monomethoxy-polyethyleneglycol)-2,3-dimyristoylglycerol (PEG-DMG), a pegylated phosphatidylethanoloamine (PEG-PE), a PEG succinate diacylglycerol (PEG-S-DAG) such as 4-O-(2',3'-di(tetradecanoyloxy)propyl-1-O-(ω-methoxy(polyethoxy)ethyl)butanedioate (PEG-S-DMG), a pegylated ceramide (PEG-cer), or a PEG dialkoxypropylcarbamate such as ω-methoxy(polyethoxy)ethyl-N-(2,3-di(tetradecanoxy)propyl)carbamate or 2,3-di(tetradecanoxy)propyl-N-(ω-methoxy(polyethoxy)ethyl)carbamate. In various embodiments, the molar ratio of the cationic lipid to the pegylated lipid ranges from about 100:1 to about 25:1.

In some embodiments, the LNPs comprise a pegylated lipid having the following structure (IV):

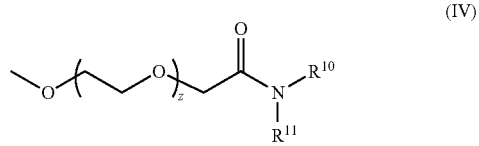
(IV)

or a pharmaceutically acceptable salt, tautomer or stereoisomer thereof, wherein:

$R^{10}$ and $R^{11}$ are each independently a straight or branched, saturated or unsaturated alkyl chain containing from 10 to 30 carbon atoms, wherein the alkyl chain is optionally interrupted by one or more ester bonds; and z has mean value ranging from 30 to 60.

In some of the foregoing embodiments of the pegylated lipid (IV), $R^{10}$ and $R^{11}$ are not both n-octadecyl when z is 42. In some other embodiments, $R^{10}$ and $R^{11}$ are each independently a straight or branched, saturated or unsaturated alkyl chain containing from 10 to 18 carbon atoms. In some embodiments, $R^{10}$ and $R^{11}$ are each independently a straight or branched, saturated or unsaturated alkyl chain containing from 12 to 16 carbon atoms. In some embodiments, $R^{10}$ and $R^{11}$ are each independently a straight or branched, saturated or unsaturated alkyl chain containing 12 carbon atoms. In some embodiments, $R^{10}$ and $R^{11}$ are each independently a straight or branched, saturated or unsaturated alkyl chain containing 14 carbon atoms. In other embodiments, $R^{10}$ and $R^{11}$ are each independently a straight or branched, saturated or unsaturated alkyl chain containing 16 carbon atoms. In still more embodiments, $R^{10}$ and $R^{11}$ are each independently a straight or branched, saturated or unsaturated alkyl chain containing 18 carbon atoms. In still other embodiments, $R^{10}$ is a straight or branched, saturated or unsaturated alkyl chain containing 12 carbon atoms and $R^{11}$ is a straight or branched, saturated or unsaturated alkyl chain containing 14 carbon atoms.

In various embodiments, z spans a range that is selected such that the PEG portion of (II) has an average molecular weight of about 400 to about 6000 g/mol. In some embodiments, the average z is about 45.

In other embodiments, the pegylated lipid has one of the following structures:

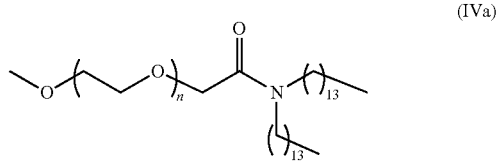
(IVa)

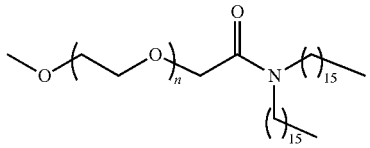
(IVb)

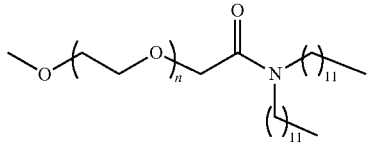
(IVc)

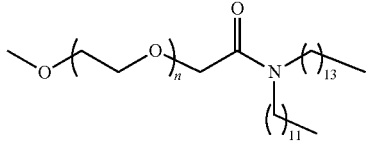
(IVd)

wherein n is an integer selected such that the average molecular weight of the pegylated lipid is about 2500 g/mol.

In some embodiments, the additional lipid is present in the LNP in an amount from about 1 to about 10 mole percent. In one embodiment, the additional lipid is present in the LNP in an amount from about 1 to about 5 mole percent. In one embodiment, the additional lipid is present in the LNP in about 1 mole percent or about 1.5 mole percent.

In some embodiments, the LNPs comprise a lipid of Formula (I), a nucleoside-modified RNA, a neutral lipid, a steroid and a pegylated lipid. In some embodiments the lipid of Formula (I) is compound I-6. In different embodiments, the neutral lipid is DSPC. In other embodiments, the steroid is cholesterol. In still different embodiments, the pegylated lipid is compound IVa.

In some embodiments, the LNP comprises one or more targeting moieties, which are capable of targeting the LNP to a cell or cell population. For example, in one embodiment, the targeting moiety is a ligand, which directs the LNP to a receptor found on a cell surface.

In some embodiments, the LNP comprises one or more internalization domains. For example, in one embodiment, the LNP comprises one or more domains, which bind to a cell to induce the internalization of the LNP. For example, in one embodiment, the one or more internalization domains bind to a receptor found on a cell surface to induce receptor-mediated uptake of the LNP. In some embodiments, the LNP is capable of binding a biomolecule in vivo, where the LNP-bound biomolecule can then be recognized by a cell-surface receptor to induce internalization. For example, in one embodiment, the LNP binds systemic ApoE, which leads to the uptake of the LNP and associated cargo.

Other exemplary LNPs and their manufacture are described in the art, for example in U.S. Patent Application Publication No. US20120276209, Semple et al., 2010, Nat Biotechnol., 28(2):172-176; Akinc et al., 2010, Mol Ther., 18(7): 1357-1364; Basha et al., 2011, Mol Ther, 19(12): 2186-2200; Leung et al., 2012, J Phys Chem C Nanomater Interfaces, 116(34): 18440-18450; Lee et al., 2012, Int J Cancer., 131(5): E781-90; Belliveau et al., 2012, Mol Ther nucleic Acids, 1: e37; Jayaraman et al., 2012, Angew Chem Int Ed Engl., 51(34): 8529-8533; Mui et al., 2013, Mol Ther Nucleic Acids. 2, e139; Maier et al., 2013, Mol Ther., 21(8): 1570-1578; and Tam et al., 2013, Nanomedicine, 9(5): 665-74, each of which are incorporated by reference in their entirety.

The following Reaction Schemes illustrate methods to make lipids of Formula (I), (II) or (III).

GENERAL REACTION SCHEME 1

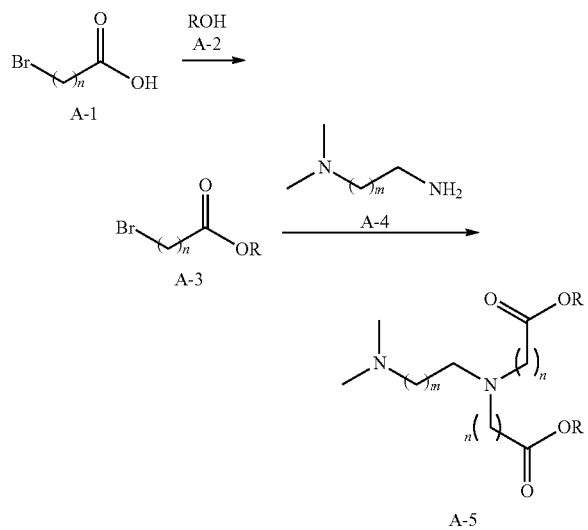

Embodiments of the lipid of Formula (I) (e.g., compound A-5) can be prepared according to General Reaction Scheme 1 ("Method A"), wherein R is a saturated or unsaturated $C_1$-$C_{24}$ alkyl or saturated or unsaturated cycloalkyl, m is 0 or 1 and n is an integer from 1 to 24. Referring to General Reaction Scheme 1, compounds of structure A-1 can be purchased from commercial sources or prepared according to methods familiar to one of ordinary skill in the art. A mixture of A-1, A-2 and DMAP is treated with DCC to give the bromide A-3. A mixture of the bromide A-3, a base (e.g., N,N-diisopropylethylamine) and the N,N-dimethyldiamine A-4 is heated at a temperature and time sufficient to produce A-5 after any necessarily workup and or purification step.

GENERAL REACTION SCHEME 2

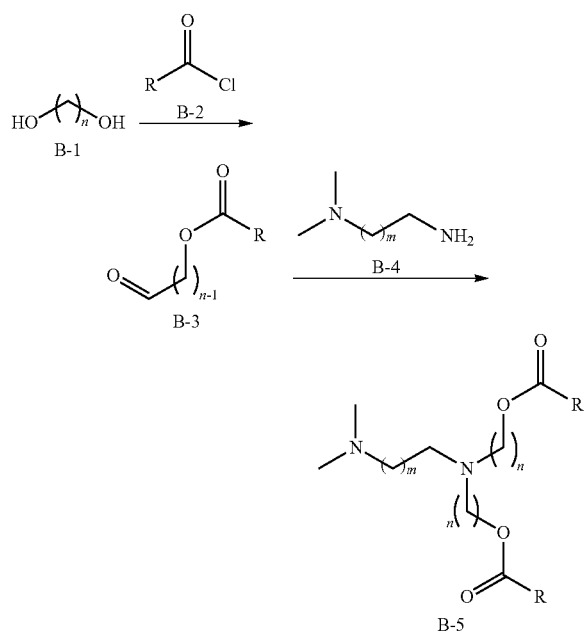

Other embodiments of the compound of Formula (I) (e.g., compound B-5) can be prepared according to General Reaction Scheme 2 ("Method B"), wherein R is a saturated or unsaturated $C_1$-$C_{24}$ alkyl or saturated or unsaturated cycloalkyl, m is 0 or 1 and n is an integer from 1 to 24. As shown in General Reaction Scheme 2, compounds of structure B-1 can be purchased from commercial sources or prepared according to methods familiar to one of ordinary skill in the art. A solution of B-1 (1 equivalent) is treated with acid chloride B-2 (1 equivalent) and a base (e.g., triethylamine). The crude product is treated with an oxidizing agent (e.g., pyridinum chlorochromate) and intermediate product B-3 is recovered. A solution of crude B-3, an acid (e.g., acetic acid), and N,N-dimethylaminoamine B-4 is then treated with a reducing agent (e.g., sodium triacetoxyborohydride) to obtain B-5 after any necessary work up and/or purification.

It should be noted that although starting materials A-1 and B-1 are depicted above as including only saturated methylene carbons, starting materials which include carbon-carbon double bonds may also be employed for preparation of compounds which include carbon-carbon double bonds.

GENERAL REACTION SCHEME 3

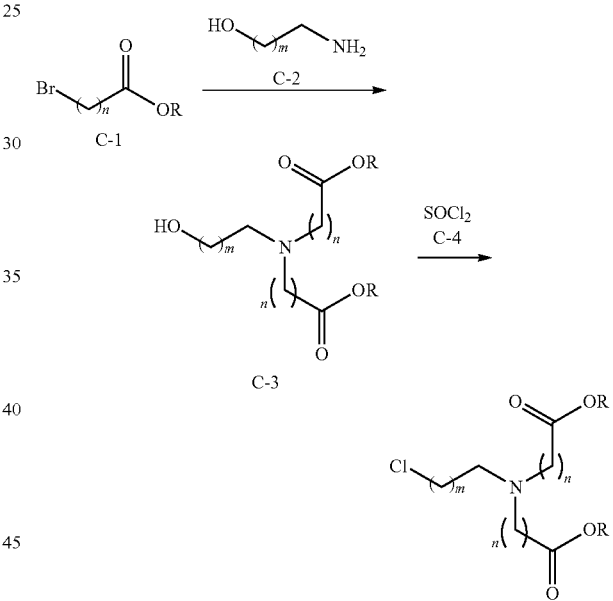

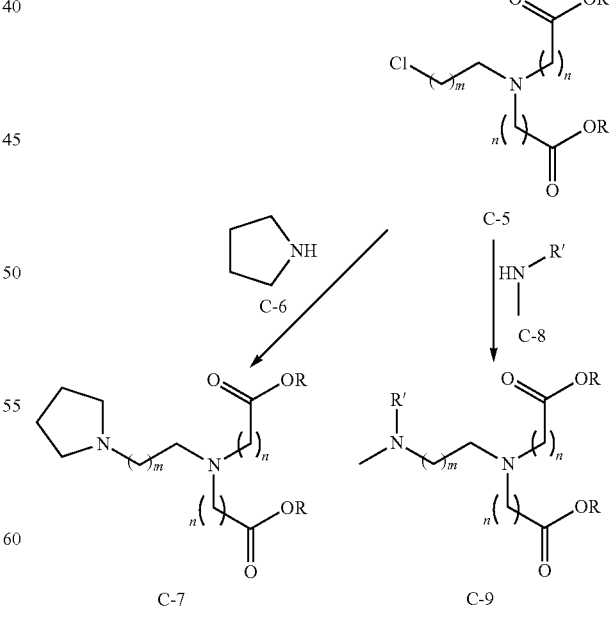

Different embodiments of the lipid of Formula (I) (e.g., compound C-7 or C9) can be prepared according to General Reaction Scheme 3 ("Method C"), wherein R is a saturated or unsaturated $C_1$-$C_{24}$ alkyl or saturated or unsaturated cycloalkyl, m is 0 or 1 and n is an integer from 1 to 24. Referring to General Reaction Scheme 3, compounds of structure C-1 can be purchased from commercial sources or prepared according to methods familiar to one of ordinary skill in the art.

GENERAL REACTION SCHEME 4

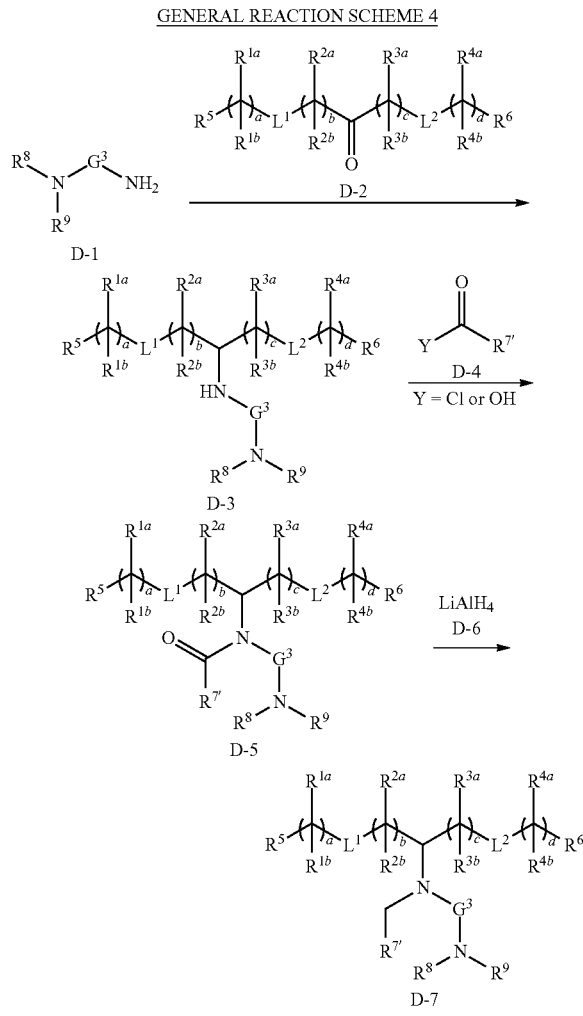

Embodiments of the compound of Formula (II) (e.g., compounds D-5 and D-7) can be prepared according to General Reaction Scheme 4 ("Method D"), wherein $R^{1a}$, $R^{1b}$, $R^{2a}$, $R^{2b}$, $R^{3a}$, $R^{3b}$, $R^{4a}$, $R^{4b}$, $R^5$, $R^6$, $R^8$, $R^9$, $L^1$, $L^2$, $G^1$, $G^2$, $G^3$, a, b, c and d are as defined herein, and $R^{7'}$ represents $R^7$ or a $C_3$-$C_{19}$ alkyl. Referring to General Reaction Scheme 1, compounds of structure D-1 and D-2 can be purchased from commercial sources or prepared according to methods familiar to one of ordinary skill in the art. A solution of D-1 and D-2 is treated with a reducing agent (e.g., sodium triacetoxyborohydride) to obtain D-3 after any necessary work up. A solution of D-3 and a base (e.g. trimethylamine, DMAP) is treated with acyl chloride D-4 (or carboxylic acid and DCC) to obtain D-5 after any necessary work up and/or purification. D-5 can be reduced with LiAlH4 D-6 to give D-7 after any necessary work up and/or purification.

GENERAL REACTION SCHEME 5

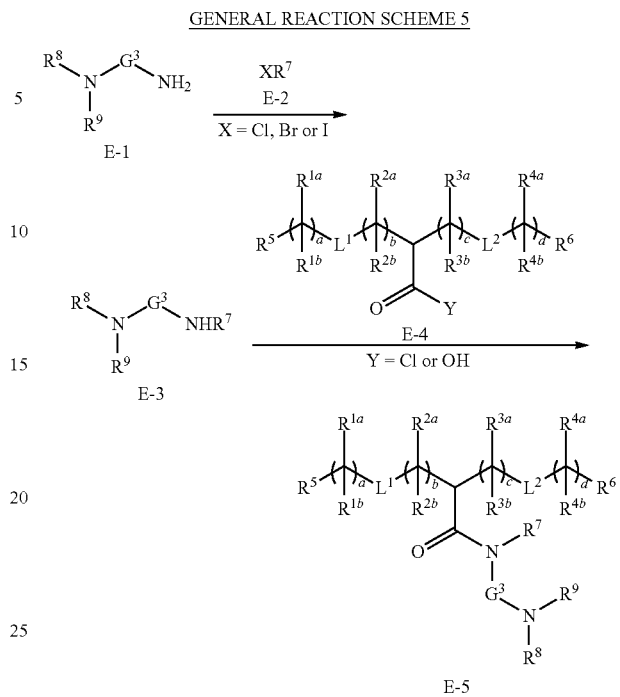

Embodiments of the lipid of Formula (II) (e.g., compound E-5) can be prepared according to General Reaction Scheme 5 ("Method E"), wherein $R^{1a}$, $R^{1b}$, $R^{2a}$, $R^{2b}$, $R^{3a}$, $R^{3b}$, $R^{4a}$, $R^{4b}$, $R^5$, $R^6$, $R^7$, $R^8$, $R^9$, $L^1$, $L^2$, $G^3$, a, b, c and d are as defined herein. Referring to General Reaction Scheme 2, compounds of structure E-1 and E-2 can be purchased from commercial sources or prepared according to methods familiar to one of ordinary skill in the art. A mixture of E-1 (in excess), E-2 and a base (e.g., potassium carbonate) is heated to obtain E-3 after any necessary work up. A solution of E-3 and a base (e.g. trimethylamine, DMAP) is treated with acyl chloride E-4 (or carboxylic acid and DCC) to obtain E-5 after any necessary work up and/or purification.

GENERAL REACTION SCHEME 6

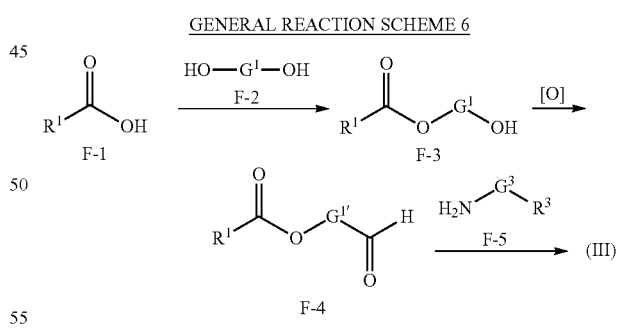

General Reaction Scheme 6 provides an exemplary method (Method F) for preparation of Lipids of Formula (III). $G^1$, $G^3$, $R^1$ and $R^3$ in General Reaction Scheme 6 are as defined herein for Formula (III), and G1' refers to a one-carbon shorter homologue of G1. Compounds of structure F-1 are purchased or prepared according to methods known in the art. Reaction of F-1 with diol F-2 under appropriate condensation conditions (e.g., DCC) yields ester/alcohol F-3, which can then be oxidized (e.g., PCC) to aldehyde F-4. Reaction of F-4 with amine F-5 under reductive amination conditions yields a lipid of Formula (III).

It should be noted that various alternative strategies for preparation of lipids of Formula (III) are available to those of ordinary skill in the art. For example, other lipids of Formula (III) wherein $L^1$ and $L^2$ are other than ester can be prepared according to analogous methods using the appropriate starting material. Further, General Reaction Scheme 6 depicts preparation of a lipids of Formula (III), wherein $G^1$ and $G^2$ are the same; however, this is not a required aspect of the invention and modifications to the above reaction scheme are possible to yield compounds wherein $G^1$ and $G^2$ are different.

It will be appreciated by those skilled in the art that in the process described herein the functional groups of intermediate compounds may need to be protected by suitable protecting groups. Such functional groups include hydroxy, amino, mercapto and carboxylic acid. Suitable protecting groups for hydroxy include trialkylsilyl or diarylalkylsilyl (for example, t-butyldimethylsilyl, t-butyldiphenylsilyl or trimethylsilyl), tetrahydropyranyl, benzyl, and the like. Suitable protecting groups for amino, amidino and guanidino include t-butoxycarbonyl, benzyloxycarbonyl, and the like. Suitable protecting groups for mercapto include —C(O)—R" (where R" is alkyl, aryl or arylalkyl), p-methoxybenzyl, trityl and the like. Suitable protecting groups for carboxylic acid include alkyl, aryl or arylalkyl esters. Protecting groups may be added or removed in accordance with standard techniques, which are known to one skilled in the art and as described herein. The use of protecting groups is described in detail in Green, T. W. and P. G. M. Wutz, *Protective Groups in Organic Synthesis* (1999), 3rd Ed., Wiley. As one of skill in the art would appreciate, the protecting group may also be a polymer resin such as a Wang resin, Rink resin or a 2-chlorotrityl-chloride resin.

Pharmaceutical Compositions

The formulations of the pharmaceutical compositions described herein may be prepared by any method known or hereafter developed in the art of pharmacology. In general, such preparatory methods include the step of bringing the active ingredient into association with a carrier or one or more other accessory ingredients, and then, if necessary or desirable, shaping or packaging the product into a desired single- or multi-dose unit.

Although the description of pharmaceutical compositions provided herein are principally directed to pharmaceutical compositions which are suitable for ethical administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and perform such modification with merely ordinary, if any, experimentation. Subjects to which administration of the pharmaceutical compositions of the invention is contemplated include, but are not limited to, humans and other primates, mammals including commercially relevant mammals such as non-human primates, cattle, pigs, horses, sheep, cats, and dogs.

Pharmaceutical compositions that are useful in the methods of the invention may be prepared, packaged, or sold in formulations suitable for ophthalmic, oral, rectal, vaginal, parenteral, topical, pulmonary, intranasal, buccal, intravenous, intracerebroventricular, intradermal, intramuscular, or another route of administration. Other contemplated formulations include projected nanoparticles, liposomal preparations, resealed erythrocytes containing the active ingredient, and immunogenic-based formulations.

A pharmaceutical composition of the invention may be prepared, packaged, or sold in bulk, as a single unit dose, or as a plurality of single unit doses. As used herein, a "unit dose" is discrete amount of the pharmaceutical composition comprising a predetermined amount of the active ingredient. The amount of the active ingredient is generally equal to the dosage of the active ingredient, which would be administered to a subject or a convenient fraction of such a dosage such as, for example, one-half or one-third of such a dosage.

The relative amounts of the active ingredient, the pharmaceutically acceptable carrier, and any additional ingredients in a pharmaceutical composition of the invention will vary, depending upon the identity, size, and condition of the subject treated and further depending upon the route by which the composition is to be administered. By way of example, the composition may comprise between 0.1% and 100% (w/w) active ingredient.

In addition to the active ingredient, a pharmaceutical composition of the invention may further comprise one or more additional pharmaceutically active agents.

Controlled- or sustained-release formulations of a pharmaceutical composition of the invention may be made using conventional technology.

As used herein, "parenteral administration" of a pharmaceutical composition includes any route of administration characterized by physical breaching of a tissue of a subject and administration of the pharmaceutical composition through the breach in the tissue. Parenteral administration thus includes, but is not limited to, administration of a pharmaceutical composition by injection of the composition, by application of the composition through a surgical incision, by application of the composition through a tissue-penetrating non-surgical wound, and the like. In particular, parenteral administration is contemplated to include, but is not limited to, intraocular, intravitreal, subcutaneous, intraperitoneal, intramuscular, intradermal, intrasternal injection, intratumoral, intravenous, intracerebroventricular and kidney dialytic infusion techniques.

Formulations of a pharmaceutical composition suitable for parenteral administration comprise the active ingredient combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampules or in multi-dose containers containing a preservative. Formulations for parenteral administration include, but are not limited to, suspensions, solutions, emulsions in oily or aqueous vehicles, pastes, and implantable sustained-release or biodegradable formulations. Such formulations may further comprise one or more additional ingredients including, but not limited to, suspending, stabilizing, or dispersing agents. In one embodiment of a formulation for parenteral administration, the active ingredient is provided in dry (i.e. powder or granular) form for reconstitution with a suitable vehicle (e.g. sterile pyrogen-free water) prior to parenteral administration of the reconstituted composition.

The pharmaceutical compositions may be prepared, packaged, or sold in the form of a sterile injectable aqueous or oily suspension or solution. This suspension or solution may be formulated according to the known art, and may comprise, in addition to the active ingredient, additional ingredients such as the dispersing agents, wetting agents, or suspending agents described herein. Such sterile injectable formulations may be prepared using a non-toxic parenterally-acceptable diluent or solvent, such as water or 1,3- butane diol, for example. Other acceptable diluents and solvents include, but are not limited to, Ringer's solution, isotonic sodium chloride solution, and fixed oils such as synthetic mono- or di-glycerides. Other parentally-administrable formulations which are useful include those which comprise the active ingredient in microcrystalline form, in a liposomal preparation, or as a component of a biodegradable polymer systems. Compositions for sustained release or implantation may comprise pharmaceutically acceptable polymeric or hydrophobic materials such as an emulsion, an ion exchange resin, a sparingly soluble polymer, or a sparingly soluble salt.

A pharmaceutical composition of the invention may be prepared, packaged, or sold in a formulation suitable for pulmonary administration via the buccal cavity. Such a formulation may comprise dry particles which comprise the active ingredient and which have a diameter in the range from about 0.5 to about 7 nanometers. In some embodiments, the formulation may comprise dry particles which comprise the active ingredient and which have a diameter in the range from about 1 to about 6 nanometers. Such compositions are conveniently in the form of dry powders for administration using a device comprising a dry powder reservoir to which a stream of propellant may be directed to disperse the powder or using a self-propelling solvent/powder-dispensing container such as a device comprising the active ingredient dissolved or suspended in a low-boiling propellant in a sealed container. In some embodiments, such powders comprise particles wherein at least 98% of the particles by weight have a diameter greater than 0.5 nanometers and at least 95% of the particles by number have a diameter less than 7 nanometers. In some embodiments, at least 95% of the particles by weight have a diameter greater than 1 nanometer and at least 90% of the particles by number have a diameter less than 6 nanometers. In some embodiments, dry powder compositions include a solid fine powder diluent such as sugar and are conveniently provided in a unit dose form.

Low boiling propellants generally include liquid propellants having a boiling point of below 65° F. at atmospheric pressure. Generally the propellant may constitute 50 to 99.9% (w/w) of the composition, and the active ingredient may constitute 0.1 to 20% (w/w) of the composition. The propellant may further comprise additional ingredients such as a liquid non-ionic or solid anionic surfactant or a solid diluent (in some instances having a particle size of the same order as particles comprising the active ingredient).

Formulations of a pharmaceutical composition suitable for parenteral administration comprise the active ingredient combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampules or in multi-dose containers containing a preservative. Formulations for parenteral administration include, but are not limited to, suspensions, solutions, emulsions in oily or aqueous vehicles, pastes, and implantable sustained-release or biodegradable formulations. Such formulations may further comprise one or more additional ingredients including, but not limited to, suspending, stabilizing, or dispersing agents. In one embodiment of a formulation for parenteral administration, the active ingredient is provided in dry (i.e., powder or granular) form for reconstitution with a suitable vehicle (e.g., sterile pyrogen-free water) prior to parenteral administration of the reconstituted composition.

The pharmaceutical compositions may be prepared, packaged, or sold in the form of a sterile injectable aqueous or oily suspension or solution. This suspension or solution may be formulated according to the known art, and may comprise, in addition to the active ingredient, additional ingredients such as the dispersing agents, wetting agents, or suspending agents described herein. Such sterile injectable formulations may be prepared using a non-toxic parenterally-acceptable diluent or solvent, such as water or 1,3-butane diol, for example. Other acceptable diluents and solvents include, but are not limited to, Ringer's solution, isotonic sodium chloride solution, and fixed oils such as synthetic mono- or di-glycerides. Other parentally-administrable formulations that are useful include those that comprise the active ingredient in microcrystalline form, in a liposomal preparation, or as a component of a biodegradable polymer system. Compositions for sustained release or implantation may comprise pharmaceutically acceptable polymeric or hydrophobic materials such as an emulsion, an ion exchange resin, a sparingly soluble polymer, or a sparingly soluble salt.

As used herein, "additional ingredients" include, but are not limited to, one or more of the following: excipients; surface active agents; dispersing agents; inert diluents; granulating and disintegrating agents; binding agents; lubricating agents; sweetening agents; flavoring agents; coloring agents; preservatives; physiologically degradable compositions such as gelatin; aqueous vehicles and solvents; oily vehicles and solvents; suspending agents; dispersing or wetting agents; emulsifying agents, demulcents; buffers; salts; thickening agents; fillers; emulsifying agents; antioxidants; antibiotics; antifungal agents; stabilizing agents; and pharmaceutically acceptable polymeric or hydrophobic materials. Other "additional ingredients" which may be included in the pharmaceutical compositions of the invention are known in the art and described, for example in Remington's Pharmaceutical Sciences (1985, Genaro, ed., Mack Publishing Co., Easton, Pa.), which is incorporated herein by reference.

Treatment Methods

The present invention provides methods of inducing an adaptive immune response against HCV in a subject comprising administering an effective amount of a composition comprising one or more isolated nucleic acids encoding one or more HCV antigens.

In one embodiment, the method provides immunity in the subject to HCV, HCV infection, or to a disease or disorder associated with HCV. The present invention thus provides a method of treating or preventing the infection, disease, or disorder associated with HCV.

In one embodiment, the composition is administered to a subject having an infection, disease, or disorder associated with HCV. In one embodiment, the composition is administered to a subject at risk for developing the infection, disease, or disorder associated with HCV. For example, the composition may be administered to a subject who is at risk for being in contact with HCV. In one embodiment, the composition is administered to a subject who lives in, traveled to, or is expected to travel to a geographic region in which HCV is prevalent. In one embodiment, the composition is administered to a subject who is in contact with or expected to be in contact with another person who lives in, traveled to, or is expected to travel to a geographic region in which HCV is prevalent. In one embodiment, the composition is administered to a subject who has knowingly been exposed to HCV through their occupation, sexual, or other contact.

In one embodiment, the method comprises administering a composition comprising one or more nucleoside-modified nucleic acid molecules encoding one or more HCV antigens. In one embodiment, the method comprises administering a composition comprising a first nucleoside-modified nucleic acid molecule encoding one or more HCV antigens and a second nucleoside-modified nucleic acid molecule encoding one or more HCV antigens. In one embodiment, the method comprises administering a composition comprising a one or more nucleoside-modified nucleic acid molecules encoding a plurality of lineage HCV antigens described herein.

In one embodiment, the method comprises administering one or more compositions, each composition comprising one or more nucleoside-modified nucleic acid molecules encoding one or more HCV antigens. In one embodiment, the method comprises administering a first composition comprising one or more nucleoside-modified nucleic acid molecules encoding one or more HCV antigens and administering a second composition comprising one or more nucleoside-modified nucleic acid molecules encoding one or more HCV antigens. In one embodiment, the method comprises administering a plurality of compositions, each composition comprising one or more nucleoside-modified nucleic acid molecules encoding one or more lineage HCV antigens described herein. In some embodiments, the method comprises a staggered administration of the plurality of compositions.

In some embodiments, the method comprises administering to subject a plurality of nucleoside-modified nucleic acid molecules encoding a plurality of HCV antigens, adjuvants, or a combination thereof.

In some embodiments, the method of the invention allows for sustained expression of the HCV antigen or adjuvant, described herein, for at least several days following administration. In some embodiments, the method of the invention allows for sustained expression of the HCV antigen or adjuvant, described herein, for at least 2 weeks following administration. In some embodiments, the method of the invention allows for sustained expression of the HCV antigen or adjuvant, described herein, for at least 1 month following administration. However, the method, in some embodiments, also provides for transient expression, as in some embodiments, the nucleic acid is not integrated into the subject genome.

In some embodiments, the method comprises administering nucleoside-modified RNA, which provides stable expression of the HCV antigen or adjuvant described herein. In some embodiments, administration of nucleoside-modified RNA results in little to no innate immune response, while inducing an effective adaptive immune response.

In some embodiments, the method provides sustained protection against HCV. For example, in some embodiments, the method provides sustained protection against HCV for more than 2 weeks. In some embodiments, the method provides sustained protection against HCV for 1 month or more. In some embodiments, the method provides sustained protection against HCV for 2 months or more. In some embodiments, the method provides sustained protection against HCV for 3 months or more. In some embodiments, the method provides sustained protection against HCV for 4 months or more. In some embodiments, the method provides sustained protection against HCV for 5 months or more. In some embodiments, the method provides sustained protection against HCV for 6 months or more. In some embodiments, the method provides sustained protection against HCV for 1 year or more.

In one embodiment, a single immunization of the composition induces a sustained protection against HCV for 1 month or more, 2 months or more, 3 months or more, 4 months or more, 5 months or more, 6 months or more, or 1 year or more.

Administration of the compositions of the invention in a method of treatment can be achieved in a number of different ways, using methods known in the art. In one embodiment, the method of the invention comprises systemic administration of the subject, including for example enteral or parenteral administration. In some embodiments, the method comprises intradermal delivery of the composition. In another embodiment, the method comprises intravenous delivery of the composition. In some embodiments, the method comprises intramuscular delivery of the composition. In one embodiment, the method comprises subcutaneous delivery of the composition. In one embodiment, the method comprises inhalation of the composition. In one embodiment, the method comprises intranasal delivery of the composition.

It will be appreciated that the composition of the invention may be administered to a subject either alone, or in conjunction with another agent.

The therapeutic and prophylactic methods of the invention thus encompass the use of pharmaceutical compositions encoding a HCV antigen, adjuvant, or a combination thereof, described herein to practice the methods of the invention. The pharmaceutical compositions useful for practicing the invention may be administered to deliver a dose of from 1 ng/kg/day and 100 mg/kg/day. In one embodiment, the invention envisions administration of a dose, which results in a concentration of the compound of the present invention from 10 nM and 10 µM in a mammal.

Typically, dosages which may be administered in a method of the invention to a mammal, such as a human, range in amount from 0.01 µg to about 50 mg per kilogram of body weight of the mammal, while the precise dosage administered will vary depending upon any number of factors, including but not limited to, the type of mammal and type of disease state being treated, the age of the mammal and the route of administration. In some embodiments, the dosage of the compound will vary from about 0.1 µg to about 10 mg per kilogram of body weight of the mammal. In some embodiments, the dosage will vary from about 1 µg to about 1 mg per kilogram of body weight of the mammal.

The composition may be administered to a mammal as frequently as several times daily, or it may be administered less frequently, such as once a day, once a week, once every two weeks, once a month, or even less frequently, such as once every several months, several years, or even less frequently, such as every 10-20 years, 15-30 years, or even less frequently, such as every 50-100 years. The frequency of the dose will be readily apparent to the skilled artisan and will depend upon any number of factors, such as, but not limited to, the type and severity of the disease being treated, the type and age of the mammal, etc.

In some embodiments, administration of an immunogenic composition or vaccine of the present invention may be performed by single administration or boosted by multiple administrations.

In one embodiment, the invention includes a method comprising administering one or more compositions encoding one or more HCV antigens or adjuvants described herein. In some embodiments, the method has an additive effect, wherein the overall effect of the administering the combination is approximately equal to the sum of the effects of administering each HCV antigen or adjuvant. In other embodiments, the method has a synergistic effect, wherein the overall effect of administering the combination is greater than the sum of the effects of administering each HCV antigen or adjuvant.

EXPERIMENTAL EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather should be construed to encompass any and all variations which become evident as a result of the teaching provided herein.

Without further description, it is believed that one of ordinary skill in the art can, using the preceding description and the following illustrative examples, make and utilize the present invention and practice the claimed methods. The following working examples therefore are not to be construed as limiting in any way the remainder of the disclosure.

Example 1

Hepatitis C Virus (HCV) Protection by Nucleoside-Modified mRNA Vaccination

A new vaccine platform that utilizes nucleoside modified mRNA was developed. This platform specifically induces potent T follicular helper (Tfh) cell responses. Tfh cells induce B cell proliferation, affinity maturation, class switching, high level antibody production, and long-term memory. This platform was used to develop a vaccine for Hepatitis C virus (HCV) using a novel viral envelope lineage design approach. The HCV vaccine encodes a lineage of envelope proteins expressed as a single protein/mRNA containing the core and envelope 1 and 2 proteins (C-E1-E2), which self-assemble and bud as non-infectious virus-like particles from transfected cells. In some aspects, the vaccine platform utilizes a lipid nanoparticle (LNP) to encapsulate the modified RNA. The LNP encapsulation allows efficient delivery and expression of mRNA in vivo, and the 1-methylpseudouridine nucleoside modification in the place of uridine is important for the potency of the antibody response induced by the mRNA platform through its induction of Tfh cells, although similar vaccines can be made using a variety of other nucleoside modifications or unmodified mRNA and with other lipid, carbohydrate, protein, polymer, and other delivery systems.

The unmodified sequences for the HCV E1 and E2 antigens are identified by analyzing the HCV sequence evolution of the complete E1E2 envelope gene over a period of 12 months in a treatment naive subject beginning in acute infection prior to anti-HCV antibody seroconversion through resolution of plasma viremia and cure, as described in Bailey et al. (2017, Broadly neutralizing antibodies with few somatic mutations and hepatitis C virus clearance, Journal of Clinical Investigation Insight, Volume 2), which is hereby incorporated by reference in its entirety.

This subject developed broadly neutralizing antibodies (bNAbs) that neutralized his autologous viruses, as well as a large number and proportion of heterologous viruses. Using single genome sequencing (SGS) methods, three unambiguous transmitted/founder (T/F) virus genomes that were responsible for productive clinical infection in this subject were identified. Using the same SGS methodology, HCV E1E2 sequence evolution was characterized over a one year period after which the subject underwent a spontaneous resolution of viremia. Analysis of sequential viral E1E2 sequences obtained at seven time points during this 12-month period revealed a series of stringent virus population bottlenecks, which were due to the development of autologous, strain-specific neutralizing antibodies (NAbs) that eventually evolved to acquire neutralizing breadth (bNAbs). Within the evolving virus quasiapecies, a series of virus NAb escape E1E2 variants that sustained viremia, by eluding evolving NAbs until eventually NAb breadth and potency was sufficient to extinguish virus infection, was identified. This led to sustained virus control and clinical cure of infection in this subject. Virus-antibody coevolution leading to neutralization breadth is a well-established concept in human immunodeficiency virus type 1 (HIV-1) infection, but has not been reported previously for HCV infection. Here, a series of evolving HCV E1E2 sequences that elicited sufficient NAb breadth and potency to extinguish HCV infection and to neutralize a broad panel of heterologous HCV viruses are described. These HCV E1E2 sequences are predicted to be sufficient for eliciting bNAbs in humans vaccinated by this novel RNA expression platform or any other vaccine delivery system, including virus, plasmid, protein, and peptide, and to protect humans from acquiring HCV infection. The HCV E1E2 sequences to be used in this novel HCV vaccine include, but are not limited to, those disclosed herein.

Figure 2A:
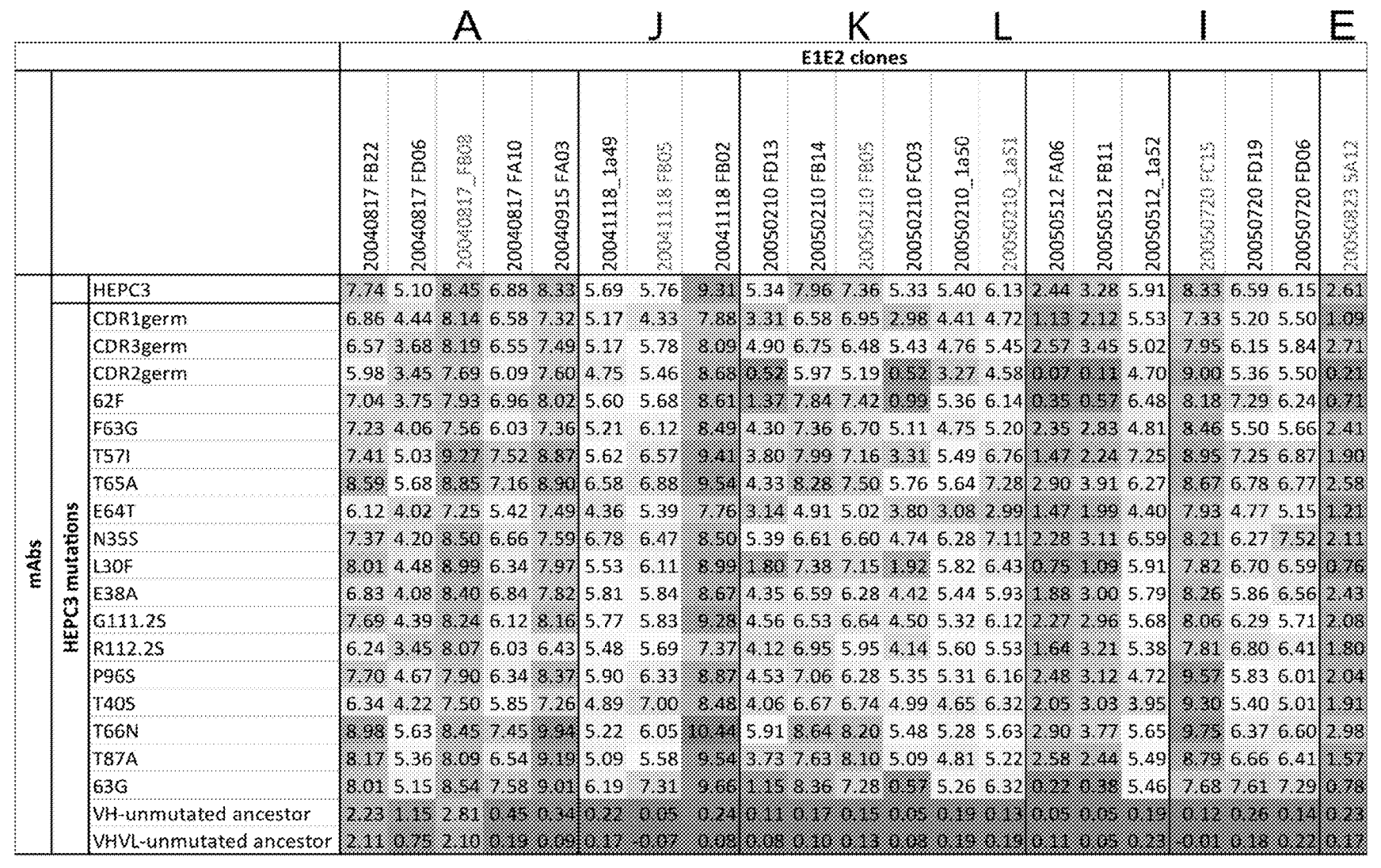
Figure 2B:
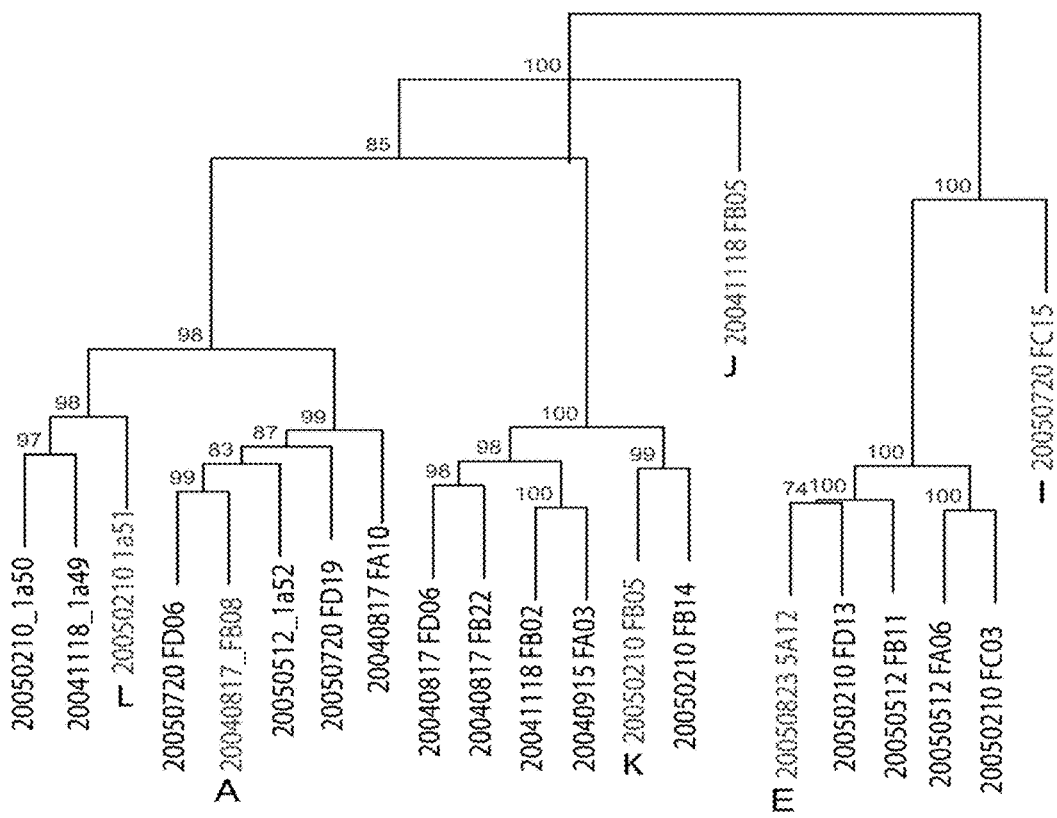
Figure 3A:
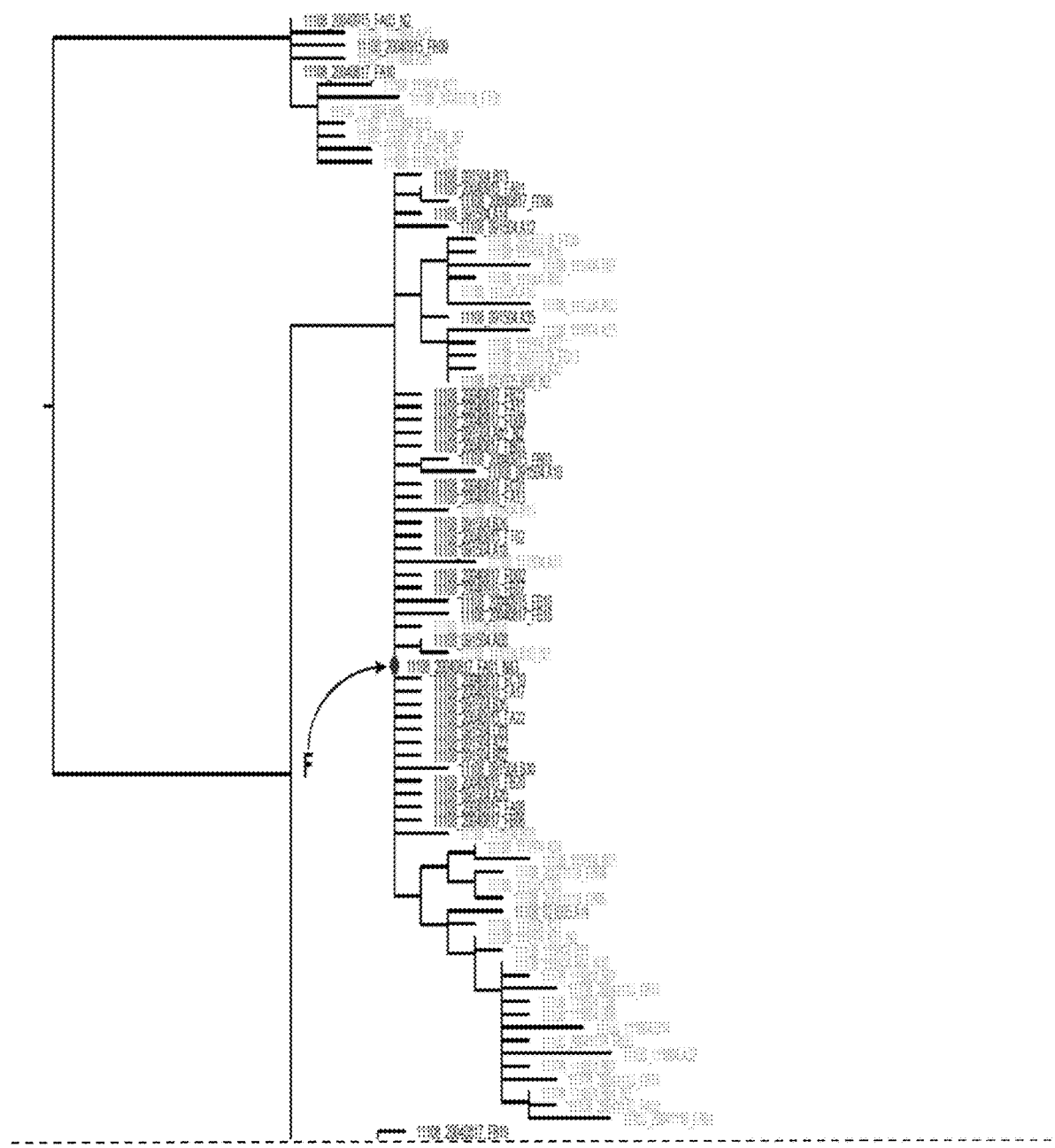
FIG. 3, comprising FIG. 3A an FIG. 3B, depict a phylogenic tree (FIG. 3A) and highlighter plot (FIG. 3B) of the E1E2 clones from patient 117.
Figure 3A:
Figure 3A:
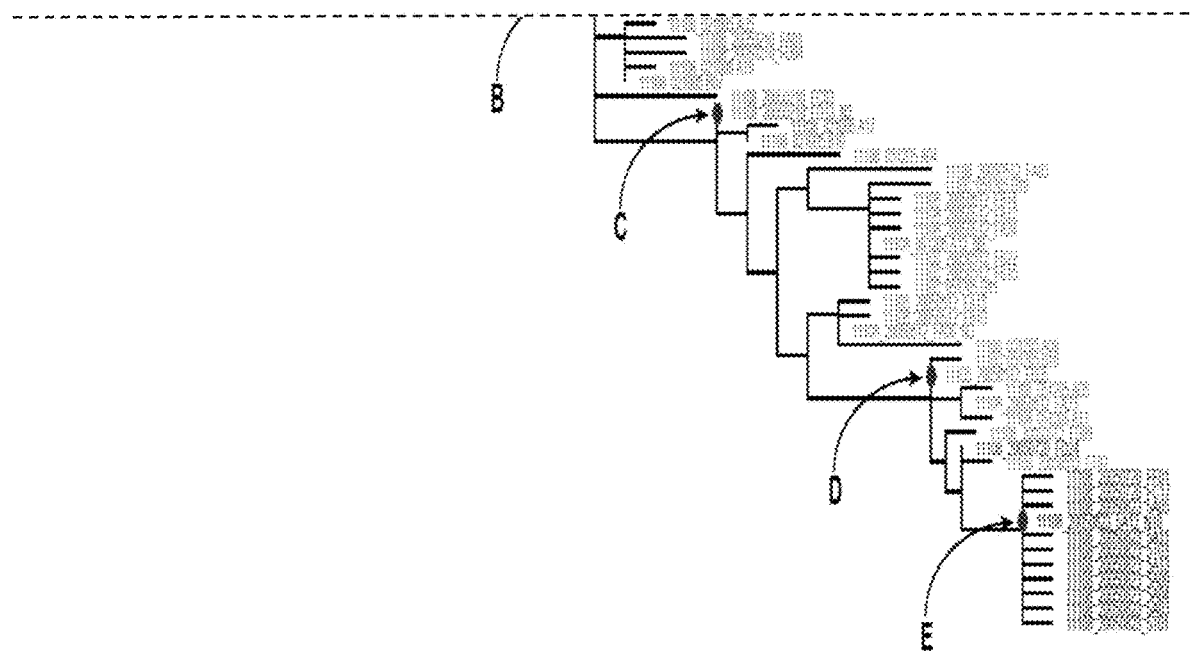
Figure 3B:
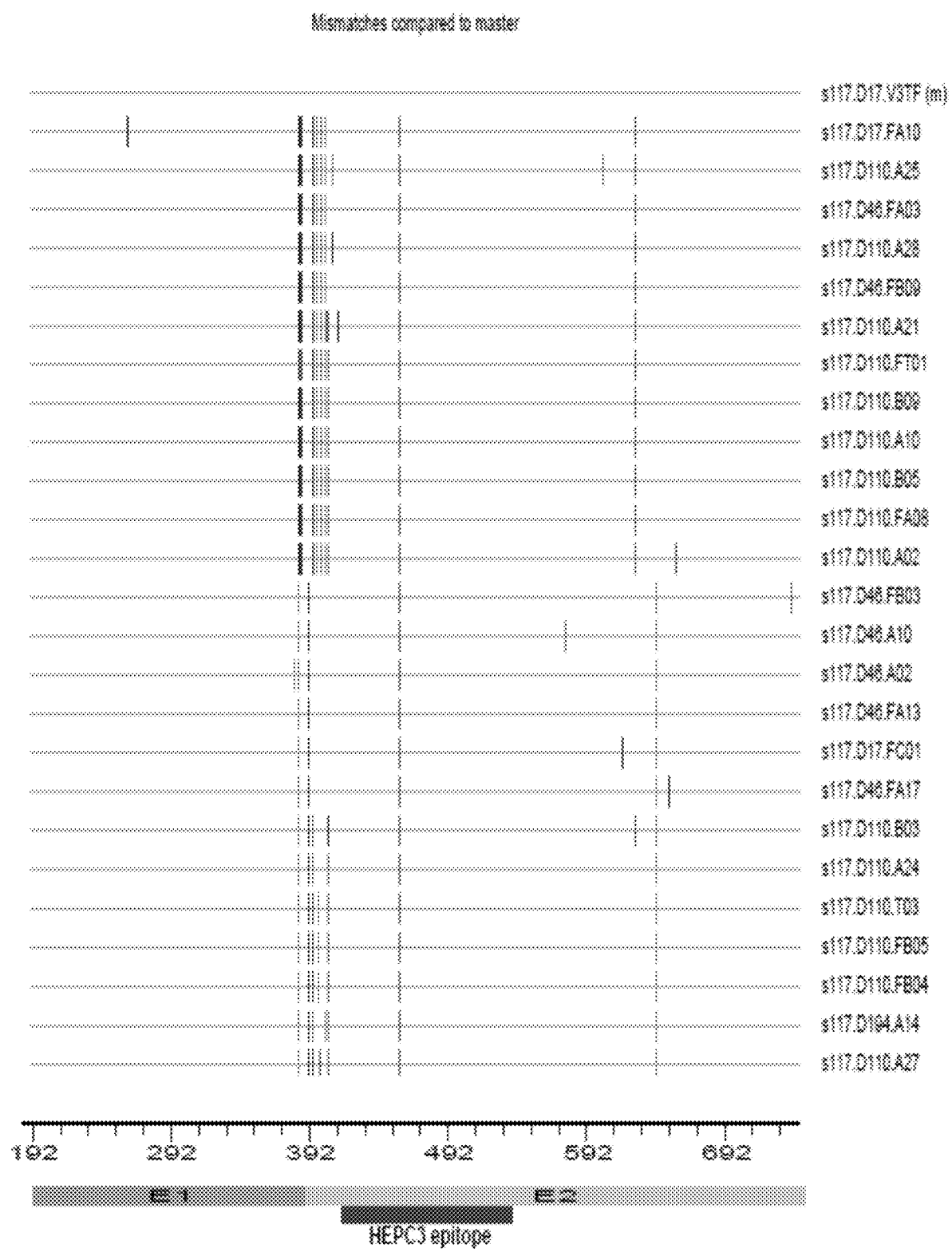
Figure 3B:
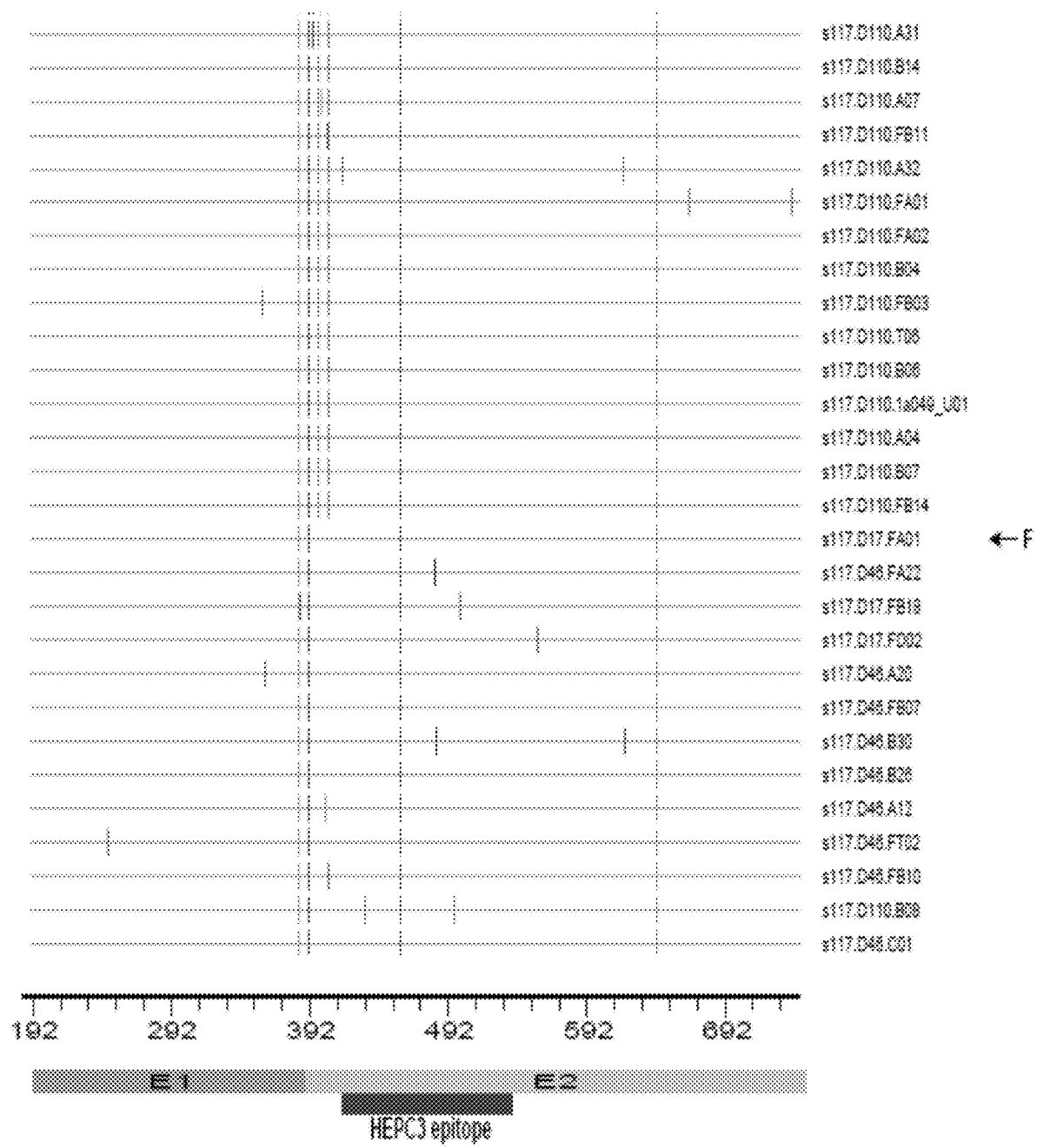
Figure 3B:
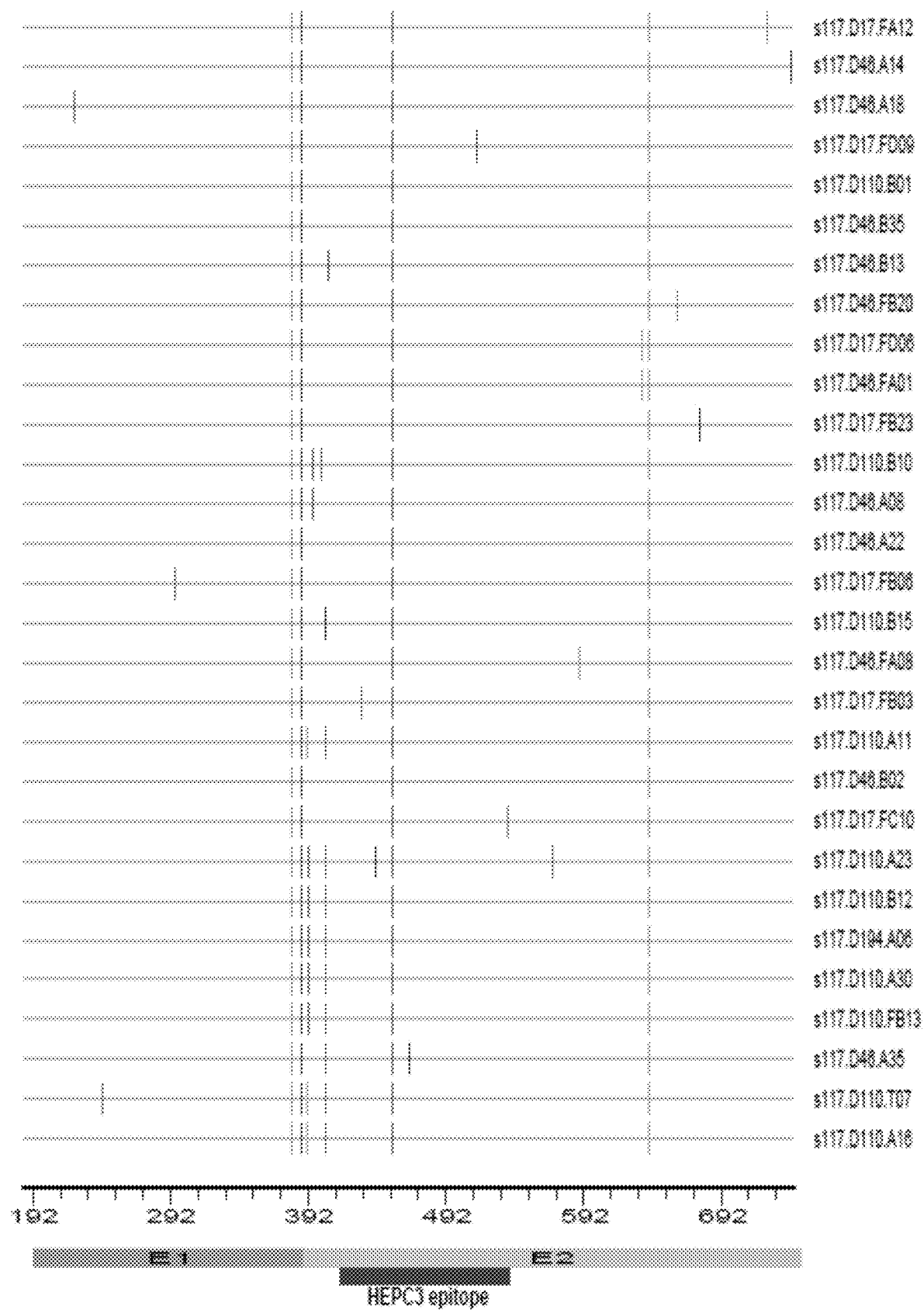
Figure 3B:
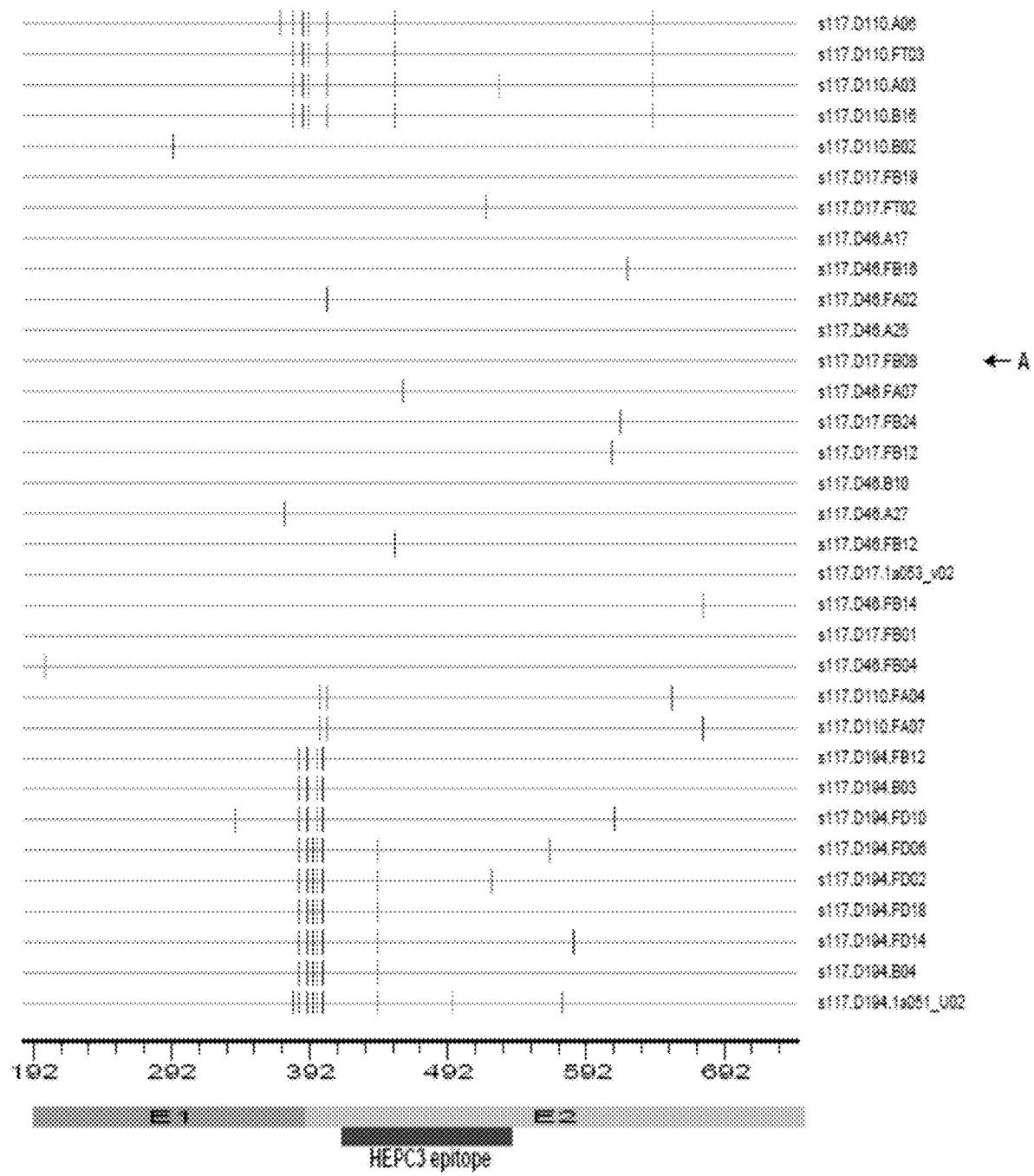
Figure 3B:
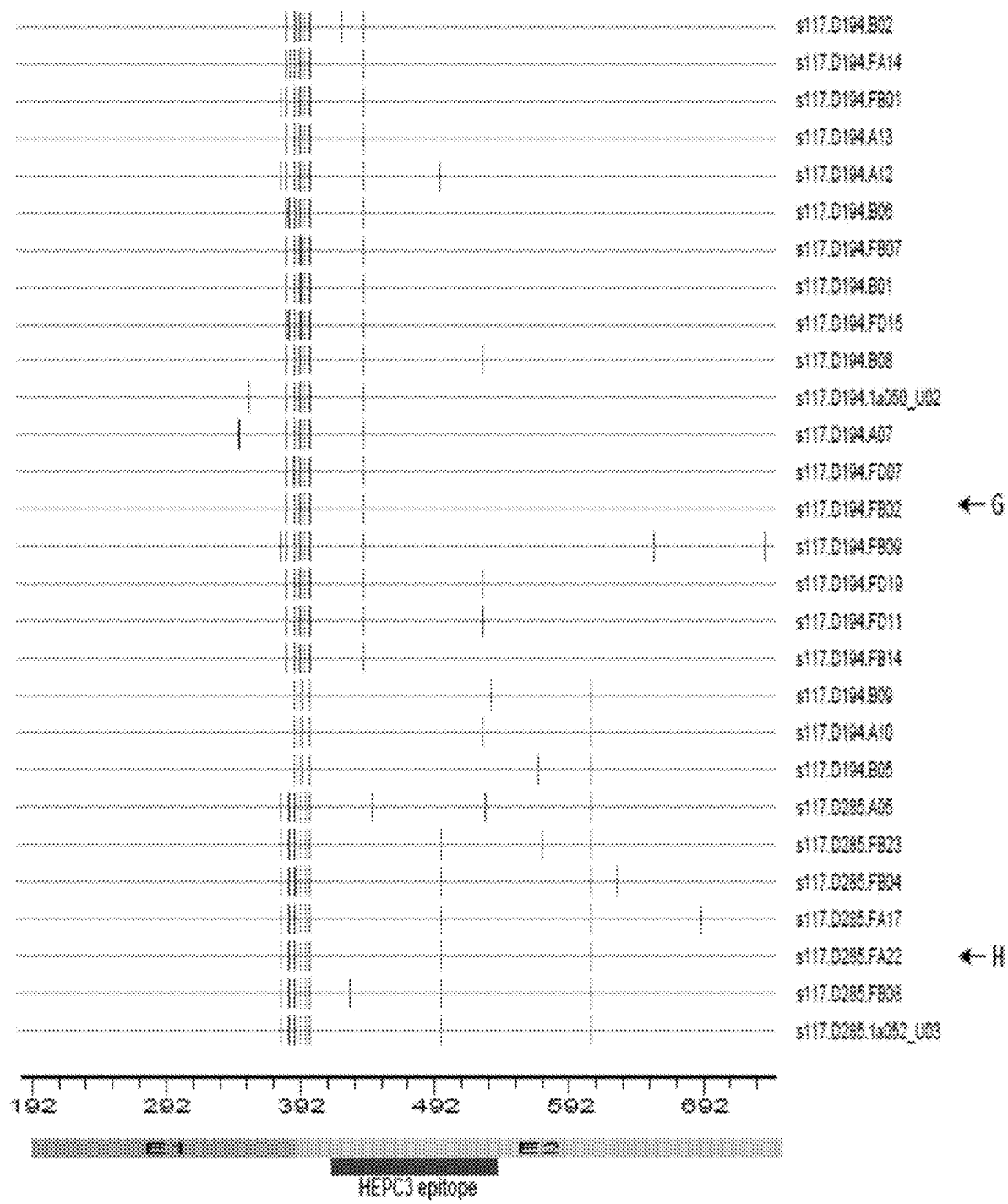
Figure 3B:
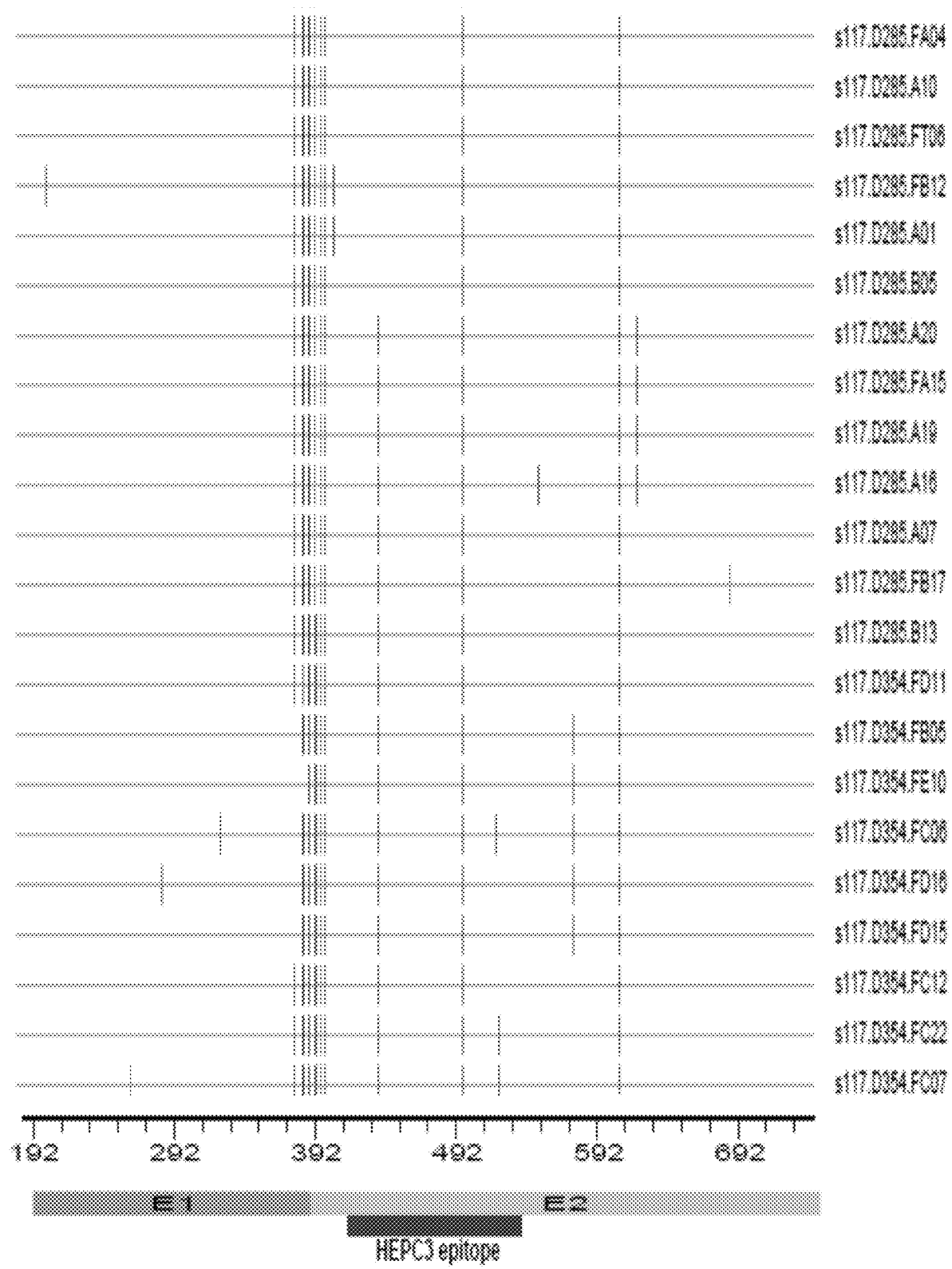
Figure 3B:
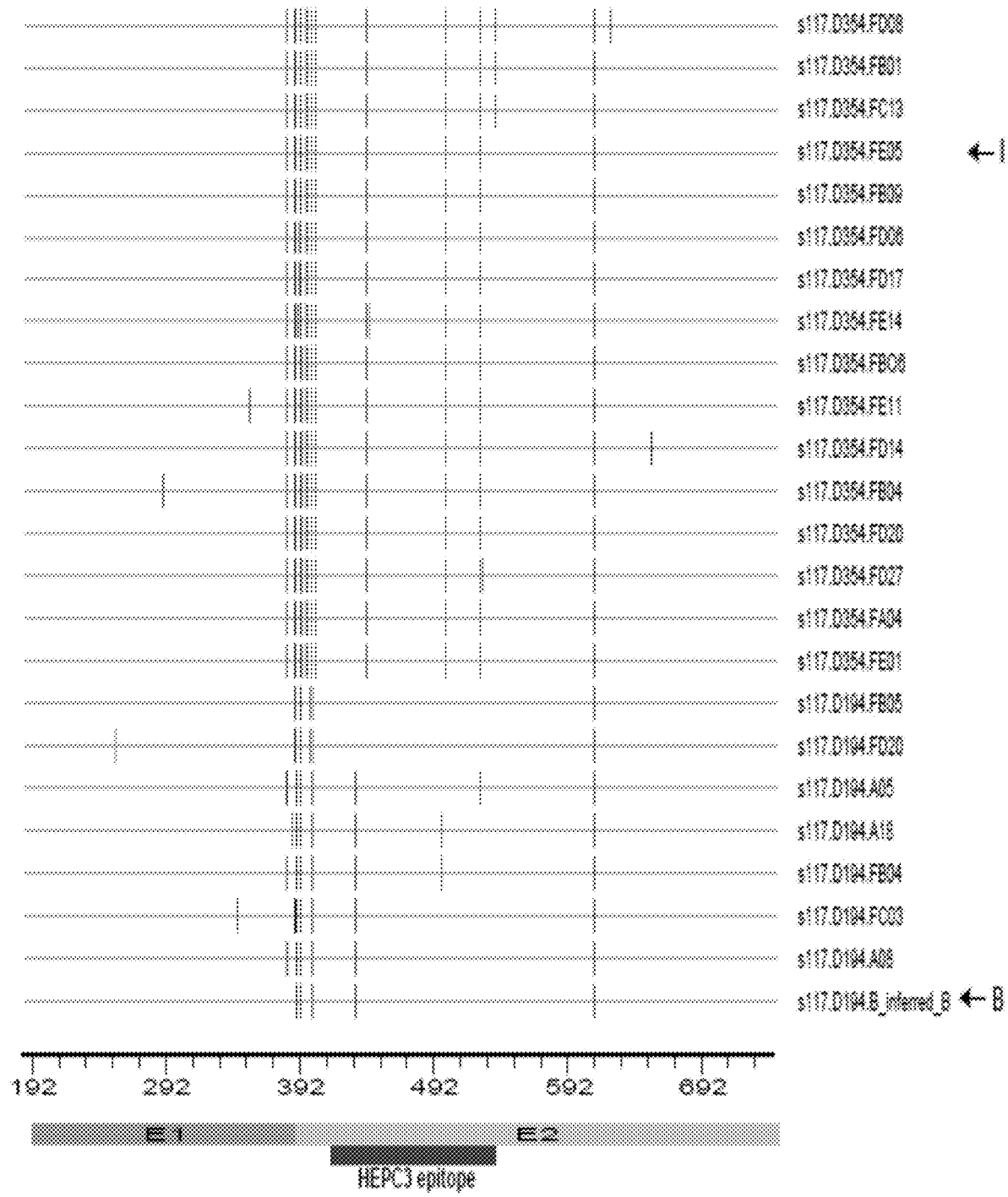
Figure 3B:
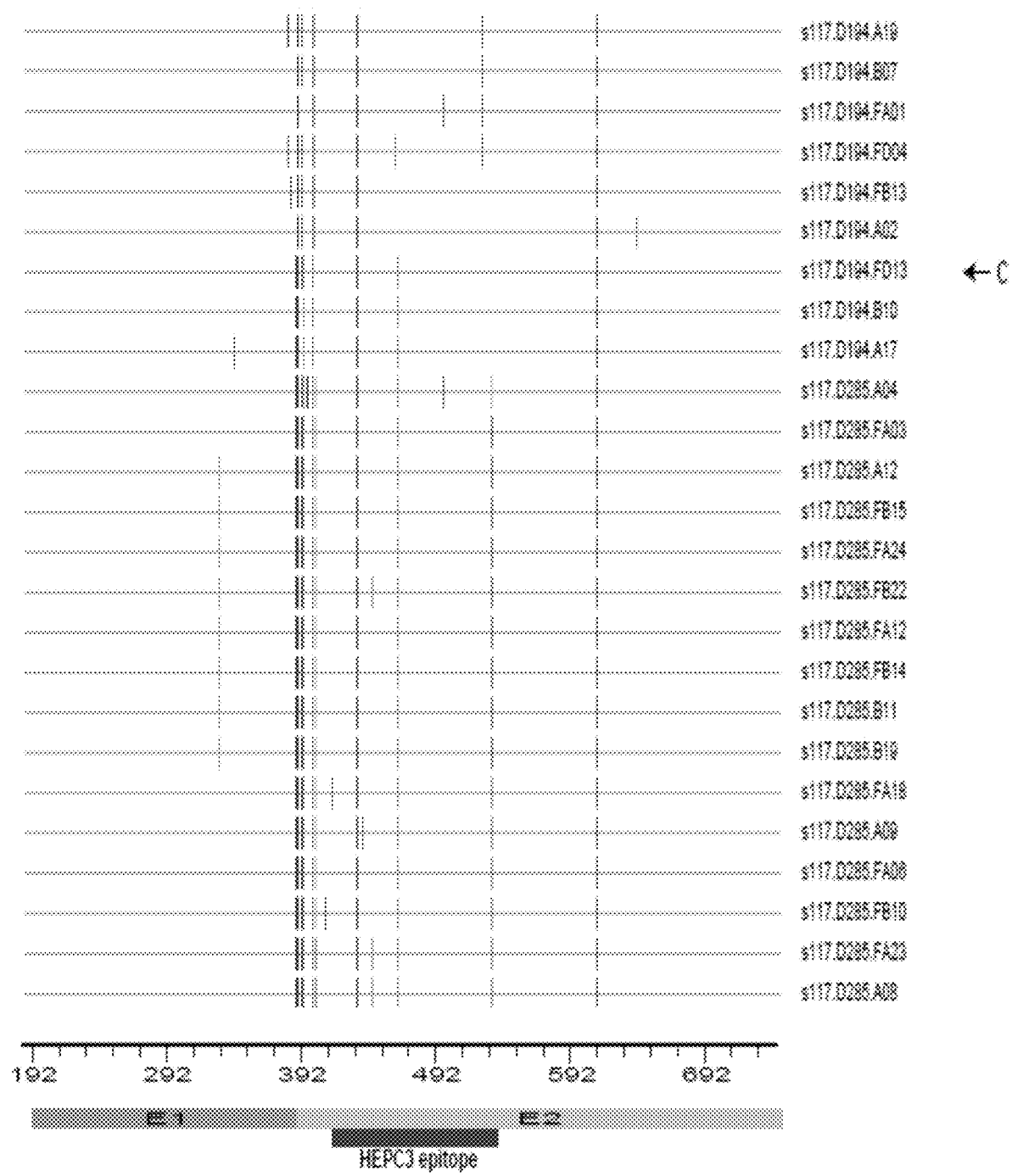
Figure 3B:
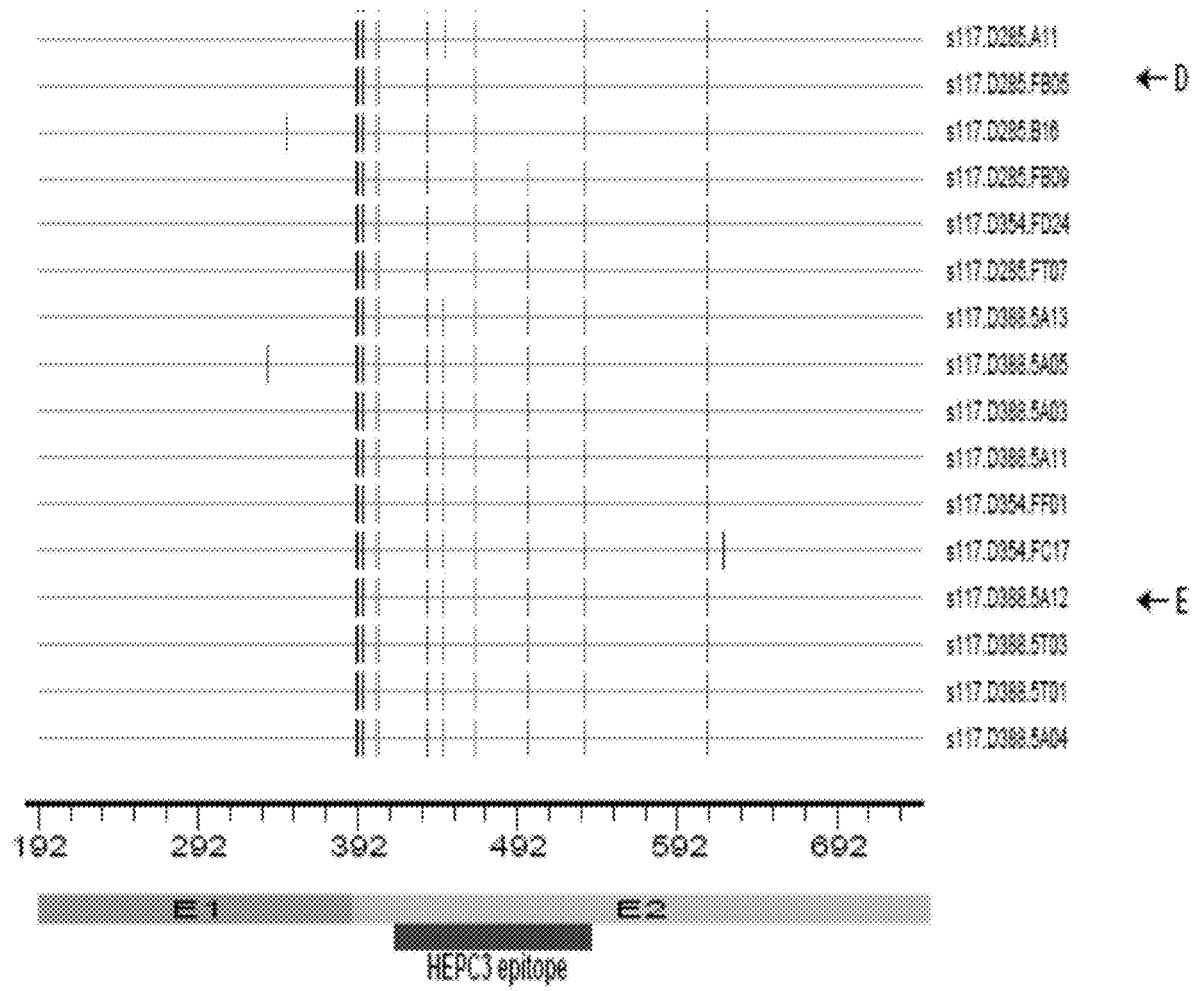
Figure 4:
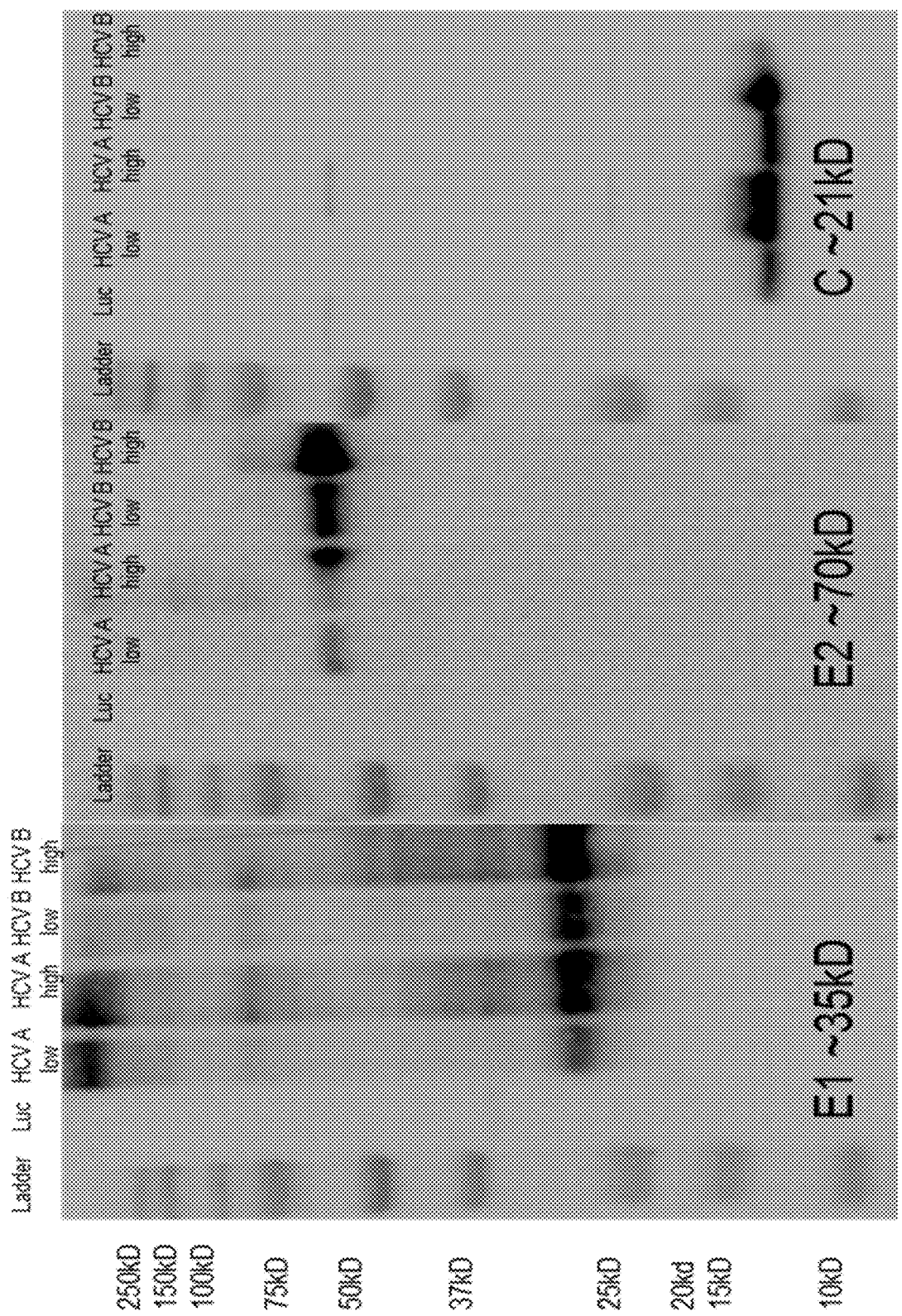
FIG. 4 depicts exemplary experimental results demonstrating that all proteins are present following transfection of 293T cells with HCV A and B mRNA, along with Luc control.

As shown in FIGS. 1A and 2A, the HCV E1E2 antigen, including those denoted A-L, as provided in Example 2 below, are capable of binding to mAbs. FIGS. 1B and 2B depicts a dendrogram depicting the phenotypic relationship between the different HCV E1E2 antigens. FIG. 3A and FIG. 3B depict a phylogenetic tree and highlighter plot of the HCV E1E2 antigens. FIG. 4 depicts a western blot of 293T cells transfected with HCV A and HCV B, showing that all proteins are present.

Example 2

Sequences

The immunogens provided below are labeled A-I based on the tree of FIG. 1, FIG. 2 and FIG. 3. In some aspects the immunogen comprises E1 and E2, as identified above. In some aspects the immunogen further comprises a core protein. The core protein may be from any HCV isolate. Provided are the amino acid sequences of the E1E2s and amino acid and nucleotide sequences of the core-E1E2 immunogens for A-I.

| E1E2 DNA sequences |
|---|
| Sequence A: E1E2 DNA (A-CE1E2-11108_20040817_FB08_A-DNA) (SEQ ID NO: 1) |
| Sequence B: E1E2 DNA (B-CE1E2-inferred-11108-DNA) (SEQ ID NO: 2) |
| Sequence C: E1E2 DNA (C-CE1E2-11108_20050210_FD13_C-DNA) (SEQ ID NO: 3) |

-continued

Sequence D: E1E2 DNA (D-CE1E2-11108_20050512_FB05_D-DNA) (SEQ ID NO: 4)

Sequence E: E1E2 DNA (E-CE1E2-11108_20050823_5A12_E-DNA) (SEQ ID NO: 5)

Sequence F: E1E2 DNA: F-CE1E2-11108_20040817_FA01_F-DNA (SEQ ID NO: 6)

Sequence G: E1E2 DNA (G-CE1E2-11108_20050210_FB02_G-DNA) (SEQ ID NO: 7)

Sequence H: E1E2 DNA (H-CE1E2-11108_20050512_FA22_H-DNA) (SEQ ID NO: 8)

Sequence I: E1E2 DNA (I-CE1E2-11108_20050720_FE05_I-DNA) (SEQ ID NO: 9)

E1E2 protein sequences

Sequence A: E1E2 protein (A-CE1E2-11108_20040817_FB08_A) (SEQ ID NO: 10)

Sequence B: E1E2 protein (B-CE1E2-inferred-11108) (SEQ ID NO: 11)

Sequence C: E1E2 protein (C-CE1E2-11108_20050210_FD13_C) (SEQ ID NO: 12)

Sequence D: E1E2 protein (D-CE1E2-11108_20050512_FB05_D) (SEQ ID NO: 13)

Sequence E: E1E2 protein (E-CE1E2-11108_20050823_5A12_E) (SEQ ID NO: 14)

Sequence F: E1E2 protein (F-CE1E2-11108_20040817_FA01_F) (SEQ ID NO: 15)

Sequence G: E1E2 protein (G-CE1E2-11108_20050210_FB02_G) (SEQ ID NO: 16)

Sequence H: E1E2 protein (H-CE1E2-11108_20050512_FA22_H) (SEQ ID NO: 17)

Sequence I: E1E2 protein (I-CE1E2-11108_20050720_FE05_I) (SEQ ID NO: 18)

Core-E1E2 DNA sequences

Sequence A: C1E1E2 DNA (A-CE1E2-11108_20040817_FB08_A-DNA) (SEQ ID NO: 19)

Sequence B: C1E1E2 DNA (B-CE1E2-inferred-11108-DNA) (SEQ ID NO: 20)

Sequence C: C1E1E2 DNA (C-CE1E2-11108_20050210_FD13_C-DNA) (SEQ ID NO: 21)

Sequence D: C1E1E2 DNA (D-CE1E2-11108_20050512_FB05_D-DNA) (SEQ ID NO: 22)

Sequence E: C1E1E2 DNA (E-CE1E2-11108_20050823_5A12_E-DNA) (SEQ ID NO: 23)

Sequence F: C1E1E2 DNA (F-CE1E2-11108_20040817_FA01_F-DNA) (SEQ ID NO: 24)

Sequence G: C1E1E2 DNA (G-CE1E2-11108_20050210_FB02_G-DNA) (SEQ ID NO: 25)

Sequence H: C1E1E2 DNA (H-CE1E2-11108_20050512_FA22_H-DNA) (SEQ ID NO: 26)

Sequence I: C1E1E2 DNA (I-CE1E2-11108_20050720_FE05_I-DNA) (SEQ ID NO: 27)

Core-E1E2 protein sequences

Sequence A: C1E1E2 protein (A-CE1E2-11108_20040817_FB08_A) (SEQ ID NO: 28)

Sequence B: C1E1E2 protein (B-CE1E2-inferred-11108) (SEQ ID NO: 29)

Sequence C: C1E1E2 protein (C-CE1E2-11108_20050210_FD13_C) (SEQ ID NO: 30)

Sequence D: C1E1E2 protein (D-CE1E2-11108_20050512_FB05_D) (SEQ ID NO: 31)

Sequence E: C1E1E2 protein (E-CE1E2-11108_20050823_5A12_E) (SEQ ID NO: 32)

Sequence F: C1E1E2 protein (F-CE1E2-11108_20040817_FA01_F) (SEQ ID NO: 33)

Sequence G: C1E1E2 protein (G-CE1E2-11108_20050210_FB02_G) (SEQ ID NO: 34)

Sequence H: C1E1E2 protein (H-CE1E2-11108_20050512_FA22_H) (SEQ ID NO: 35)

Sequence I: C1E1E2 protein (I-CE1E2-11108_20050720_FE05_I) (SEQ ID NO: 36)

Example 3

Additional Sequences (J, K, L)

Provided are E1E2 DNA sequences for the immunogens labeled J-L based on the tree of FIG. 2.

```
Sequence J
                              (SEQ ID NO: 37)
_s117_20041118_FB05

Sequence K:
                              (SEQ ID NO: 38)
_s117_20050210_FB05

Sequence L:
                              (SEQ ID NO: 39)
_s117_20050210_1a051
```

Example 4

All Sequences

Provided are nucleotide sequences for each of the HCV isolates listed in FIG. 3.

```
                              (SEQ ID NO: 40)
>s117.D110.1a049_U01

(SEQ ID NO: 41)
>s117.D110.A02

(SEQ ID NO: 42)
>s117.D110.A03

(SEQ ID NO: 43)
>s117.D110.A04

(SEQ ID NO: 44)
>s117.D110.A06

(SEQ ID NO: 45)
>s117.D110.A07

(SEQ ID NO: 46)
>s117.D110.A10

(SEQ ID NO: 47)
>s117.D110.A11

(SEQ ID NO: 48)
>s117.D110.A16

(SEQ ID NO: 49)
>s117.D110.A21

(SEQ ID NO: 50)
>s117.D110.A23

(SEQ ID NO: 51)
>s117.D110.A24

(SEQ ID NO: 52)
>s117.D110.A25

(SEQ ID NO: 53)
>s117.D110.A27

(SEQ ID NO: 54)
>s117.D110.A28

(SEQ ID NO: 55)
>s117.D110.A30

(SEQ ID NO: 56)
>s117.D110.A31
```

-continued

```
                              (SEQ ID NO: 57)
>s117.D110.A32

(SEQ ID NO: 58)
>s117.D110.B01

(SEQ ID NO: 59)
>s117.D110.B02

(SEQ ID NO: 60)
>s117.D110.B03

(SEQ ID NO: 61)
>s117.D110.B04

(SEQ ID NO: 62)
>s117.D110.B05

(SEQ ID NO: 63)
>s117.D110.B06

(SEQ ID NO: 64)
>s117.D110.B07

(SEQ ID NO: 65)
>s117.D110.B08

(SEQ ID NO: 66)
>s117.D110.B09

(SEQ ID NO: 67)
>s117.D110.B10

(SEQ ID NO: 68)
>s117.D110.B12

(SEQ ID NO: 69)
>s117.D110.B14

(SEQ ID NO: 70)
>s117.D110.B15

(SEQ ID NO: 71)
>s117.D110.B16

(SEQ ID NO: 72)
>s117.D110.FA01

(SEQ ID NO: 73)
>s117.D110.FA02

(SEQ ID NO: 74)
>s117.D110.FA04

(SEQ ID NO: 75)
>s117.D110.FA07

(SEQ ID NO: 76)
>s117.D110.FA08

(SEQ ID NO: 77)
>s117.D110.FB03

(SEQ ID NO: 78)
>s117.D110.FB04

(SEQ ID NO: 79)
>s117.D110.FB05

(SEQ ID NO: 80)
>s117.D110.FB11

(SEQ ID NO: 81)
>s117.D110.FB13

(SEQ ID NO: 82)
>s117.D110.FB14

(SEQ ID NO: 83)
>s117.D110.FT01
```

-continued

>s117.D110.FT03 (SEQ ID NO: 84)

>s117.D110.T03 (SEQ ID NO: 85)

>s117.D110.T06 (SEQ ID NO: 86)

>s117.D110.T07 (SEQ ID NO: 87)

>s117.D17.1a053_v02 (SEQ ID NO: 88)

>s117.D17.FA01 (SEQ ID NO: 89)

>s117.D17.FA10 (SEQ ID NO: 90)

>s117.D17.FA12 (SEQ ID NO: 91)

>s117.D17.FB01 (SEQ ID NO: 92)

>s117.D17.FB03 (SEQ ID NO: 93)

>s117.D17.FB06 (SEQ ID NO: 94)

>s117.D17.FB08 (SEQ ID NO: 95)

>s117.D17.FB12 (SEQ ID NO: 96)

>s117.D17.FB18 (SEQ ID NO: 97)

>s117.D17.FB19 (SEQ ID NO: 98)

>s117.D17.FB23 (SEQ ID NO: 99)

>s117.D17.FB24 (SEQ ID NO: 100)

>s117.D17.FC01 (SEQ ID NO: 101)

>s117.D17.FC10 (SEQ ID NO: 102)

>s117.D17.FD02 (SEQ ID NO: 103)

>s117.D17.FD06 (SEQ ID NO: 104)

>s117.D17.FD09 (SEQ ID NO: 105)

>s117.D17.FT02 (SEQ ID NO: 106)

>s117.D194.1a050_U02 (SEQ ID NO: 107)

>s117.D194.1a051_U02 (SEQ ID NO: 108)

>s117.D194.A02 (SEQ ID NO: 109)

>s117.D194.A05 (SEQ ID NO: 110)

>s117.D194.A06 (SEQ ID NO: 111)

>s117.D194.A07 (SEQ ID NO: 112)

>s117.D194.A08 (SEQ ID NO: 113)

>s117.D194.A10 (SEQ ID NO: 114)

>s117.D194.A12 (SEQ ID NO: 115)

>s117.D194.A13 (SEQ ID NO: 116)

>s117.D194.A14 (SEQ ID NO: 117)

>s117.D194.A17 (SEQ ID NO: 118)

>s117.D194.A18 (SEQ ID NO: 119)

>s117.D194.A19 (SEQ ID NO: 120)

>s117.D194.B01 (SEQ ID NO: 121)

>s117.D194.B02 (SEQ ID NO: 122)

>s117.D194.B03 (SEQ ID NO: 123)

>s117.D194.B04 (SEQ ID NO: 124)

>s117.D194.B05 (SEQ ID NO: 125)

>s117.D194.B06 (SEQ ID NO: 126)

>s117.D194.B07 (SEQ ID NO: 127)

>s117.D194.B08 (SEQ ID NO: 128)

>s117.D194.B09 (SEQ ID NO: 129)

>s117.D194.B10 (SEQ ID NO: 130)

>s117.D194.FA01 (SEQ ID NO: 131)

>s117.D194.FA14 (SEQ ID NO: 132)

>s117.D194.FB01 (SEQ ID NO: 133)

>s117.D194.FB02 (SEQ ID NO: 134)

>s117.D194.FB04 (SEQ ID NO: 135)

>s117.D194.FB05 (SEQ ID NO: 136)

>s117.D194.FB07 (SEQ ID NO: 137)

-continued

>s117.D194.FB09 (SEQ ID NO: 138)

>s117.D194.FB12 (SEQ ID NO: 139)

>s117.D194.FB13 (SEQ ID NO: 140)

>s117.D194.FB14 (SEQ ID NO: 141)

>s117.D194.FC03 (SEQ ID NO: 142)

>s117.D194.FD02 (SEQ ID NO: 143)

>s117.D194.FD04 (SEQ ID NO: 144)

>s117.D194.FD06 (SEQ ID NO: 145)

>s117.D194.FD07 (SEQ ID NO: 146)

>s117.D194.FD10 (SEQ ID NO: 147)

>s117.D194.FD11 (SEQ ID NO: 148)

>s117.D194.FD13 (SEQ ID NO: 149)

>s117.D194.FD14 (SEQ ID NO: 150)

>s117.D194.FD16 (SEQ ID NO: 151)

>s117.D194.FD18 (SEQ ID NO: 152)

>s117.D194.FD19 (SEQ ID NO: 153)

>s117.D194.FD20 (SEQ ID NO: 154)

>s117.D285.1a052_U03 (SEQ ID NO: 155)

>s117.D285.A01 (SEQ ID NO: 156)

>s117.D285.A04 (SEQ ID NO: 157)

>s117.D285.A05 (SEQ ID NO: 158)

>s117.D285.A07 (SEQ ID NO: 159)

>s117.D285.A08 (SEQ ID NO: 160)

>s117.D285.A09 (SEQ ID NO: 161)

>s117.D285.A10 (SEQ ID NO: 162)

>s117.D285.A11 (SEQ ID NO: 163)

>s117.D285.A12 (SEQ ID NO: 164)

-continued

>s117.D285.A16 (SEQ ID NO: 165)

>s117.D285.A19 (SEQ ID NO: 166)

>s117.D285.A20 (SEQ ID NO: 167)

>s117.D285.B05 (SEQ ID NO: 168)

>s117.D285.B11 (SEQ ID NO: 169)

>s117.D285.B13 (SEQ ID NO: 170)

>s117.D285.B16 (SEQ ID NO: 171)

>s117.D285.B19 (SEQ ID NO: 172)

>s117.D285.FA03 (SEQ ID NO: 173)

>s117.D285.FA04 (SEQ ID NO: 174)

>s117.D285.FA06 (SEQ ID NO: 175)

>s117.D285.FA12 (SEQ ID NO: 176)

>s117.D285.FA15 (SEQ ID NO: 177)

>s117.D285.FA17 (SEQ ID NO: 178)

>s117.D285.FA18 (SEQ ID NO: 179)

>s117.D285.FA22 (SEQ ID NO: 180)

>s117.D285.FA23 (SEQ ID NO: 181)

>s117.D285.FA24 (SEQ ID NO: 182)

>s117.D285.FB04 (SEQ ID NO: 183)

>s117.D285.FB05 (SEQ ID NO: 184)

>s117.D285.FB08 (SEQ ID NO: 185)

>s117.D285.FB09 (SEQ ID NO: 186)

>s117.D285.FB10 (SEQ ID NO: 187)

>s117.D285.FB12 (SEQ ID NO: 188)

>s117.D285.FB14 (SEQ ID NO: 189)

>s117.D285.FB15 (SEQ ID NO: 190)

>s117.D285.FB17 (SEQ ID NO: 191)

-continued

>s117.D285.FB22 (SEQ ID NO: 192)

>s117.D285.FB23 (SEQ ID NO: 193)

>s117.D285.FT06 (SEQ ID NO: 194)

>s117.D285.FT07 (SEQ ID NO: 195)

>s117.D354.FA04 (SEQ ID NO: 196)

>s117.D354.FB01 (SEQ ID NO: 197)

>s117.D354.FB04 (SEQ ID NO: 198)

>s117.D354.FB05 (SEQ ID NO: 199)

>s117.D354.FB09 (SEQ ID NO: 200)

>s117.D354.FBO6 (SEQ ID NO: 201)

>s117.D354.FC06 (SEQ ID NO: 202)

>s117.D354.FC07 (SEQ ID NO: 203)

>s117.D354.FC12 (SEQ ID NO: 204)

>s117.D354.FC13 (SEQ ID NO: 205)

>s117.D354.FC17 (SEQ ID NO: 206)

>s117.D354.FC22 (SEQ ID NO: 207)

>s117.D354.FD06 (SEQ ID NO: 208)

>s117.D354.FD08 (SEQ ID NO: 209)

>s117.D354.FD11 (SEQ ID NO: 210)

>s117.D354.FD14 (SEQ ID NO: 211)

>s117.D354.FD15 (SEQ ID NO: 212)

>s117.D354.FD16 (SEQ ID NO: 213)

>s117.D354.FD17 (SEQ ID NO: 214)

>s117.D354.FD20 (SEQ ID NO: 215)

>s117.D354.FD24 (SEQ ID NO: 216)

>s117.D354.FD27 (SEQ ID NO: 217)

>s117.D354.FE01 (SEQ ID NO: 218)

-continued

>s117.D354.FE05 (SEQ ID NO: 219)

>s117.D354.FE10 (SEQ ID NO: 220)

>s117.D354.FE11 (SEQ ID NO: 221)

>s117.D354.FE14 (SEQ ID NO: 222)

>s117.D354.FF01 (SEQ ID NO: 223)

>s117.D388.5A03 (SEQ ID NO: 224)

>s117.D388.5A04 (SEQ ID NO: 225)

>s117.D388.5A05 (SEQ ID NO: 226)

>s117.D388.5A11 (SEQ ID NO: 227)

>s117.D388.5A12 (SEQ ID NO: 228)

>s117.D388.5A13 (SEQ ID NO: 229)

>s117.D388.5T01 (SEQ ID NO: 230)

>s117.D388.5T03 (SEQ ID NO: 231)

>s117.D46.A02 (SEQ ID NO: 232)

>s117.D46.A08 (SEQ ID NO: 233)

>s117.D46.A10 (SEQ ID NO: 234)

>s117.D46.A12 (SEQ ID NO: 235)

>s117.D46.A14 (SEQ ID NO: 236)

>s117.D46.A17 (SEQ ID NO: 237)

>s117.D46.A18 (SEQ ID NO: 238)

>s117.D46.A20 (SEQ ID NO: 239)

>s117.D46.A22 (SEQ ID NO: 240)

>s117.D46.A25 (SEQ ID NO: 241)

>s117.D46.A27 (SEQ ID NO: 242)

>s117.D46.A35 (SEQ ID NO: 243)

>s117.D46.B02 (SEQ ID NO: 244)

>s117.D46.B10 (SEQ ID NO: 245)

-continued

| | |
|---|---|
| >s117.D46.B13 | (SEQ ID NO: 246) |
| >s117.D46.B26 | (SEQ ID NO: 247) |
| >s117.D46.B30 | (SEQ ID NO: 248) |
| >s117.D46.B35 | (SEQ ID NO: 249) |
| >s117.D46.C01 | (SEQ ID NO: 250) |
| >s117.D46.FA01 | (SEQ ID NO: 251) |
| >s117.D46.FA02 | (SEQ ID NO: 252) |
| >s117.D46.FA03 | (SEQ ID NO: 253) |
| >s117.D46.FA07 | (SEQ ID NO: 254) |
| >s117.D46.FA08 | (SEQ ID NO: 255) |
| >s117.D46.FA13 | (SEQ ID NO: 256) |
| >s117.D46.FA17 | (SEQ ID NO: 257) |
| >s117.D46.FA22 | (SEQ ID NO: 258) |
| >s117.D46.FB03 | (SEQ ID NO: 259) |
| >s117.D46.FB04 | (SEQ ID NO: 260) |
| >s117.D46.FB07 | (SEQ ID NO: 261) |
| >s117.D46.FB09 | (SEQ ID NO: 262) |
| >s117.D46.FB10 | (SEQ ID NO: 263) |
| >s117.D46.FB12 | (SEQ ID NO: 264) |
| >s117.D46.FB14 | (SEQ ID NO: 265) |
| >s117.D46.FB16 | (SEQ ID NO: 266) |
| >s117.D46.FB20 | (SEQ ID NO: 267) |
| >s117.D46.FT02 | (SEQ ID NO: 268) |

The disclosures of each and every patent, patent application, and publication cited herein are hereby incorporated herein by reference in their entirety. While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

SEQUENCE LISTING (268 sequences)

SEQ ID NO: 1 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcggccaggccgcctacaccgcctcctccttcaccgccctgctgacccccggcgccaagcagaacatccagctgatcaacaccaacggctcctggcacctgaaccgcaccgccctgaactgcaacgactccctgaacaccggctggctggccggcctgttctaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtggactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 2 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcggccgcgccgcccacaccgcctcctccttcaccgccttcttcacccccggcgccaagcagaacatccagctgatcaacaccaacggctcctggcacctgaaccgcaccgccctgaactgcaacgactccctggacaccggctggctggccggcctgttctaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 3 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcgagcgcgccgcccacgccgcctcctccttcaccgccttcctgacccccggcgccaagcagaacatccagctgatcaacaccaacggctcctggcacctgaaccgcaccgccctgaactgcaacgactccctggacaccggctggctggccggcctgttctaccaccacaagttcaactcctccggctgccccgagcgcatggcctcctgccgccccctgaccgactacgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 4 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcgagcgcgccgcccgcgccgcctcctccttcaccgccttcctgaaccccggcgccaagcagaacatccagctgatcaacaccaacggctcctggcacctgaaccgcaccgccctgaactgcaacgactccctggacaccggctggctggccggcctgttctaccaccacaagttcaactcctccggctgccccgagcgcatggcctcctgccgccccctgaccgactacgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacaacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 5 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcgaccgcgccgcccgcgccgcctcctccttcaccgccttcctgaaccccggcgccaagcagaacatccagctgatcaacaccaacggctcctggcacctgaaccgcaccgccctgaactgcaacgactccctggacaccggctggctggccggcctgttctactaccacaagttcaactcctccggctgccccgagcgcatggcctcctgccgccccctgaccgactacgaccagggctggggccccatctcccacgccaacggctccggccccgaccagcgcccctactgctggcactaccccccccgcccctgcggcatcgtgtccgccaagaccgtgtgcggccccgtgtactgcttcaccccctcccccgtggtggtgggcaccaccgaccgcgccggcgcccccgcctacaactggggcgagaacaacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 6 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccggcaccgtgctgatcggcggcgaggccgcctacaccgcctcctccttcaccgccctgctgacccccggcgccaagcagaacatccagctgatcaacaccaacggctcctggcacctgaaccgcaccgccctgaactgcaacgactccctgaacaccggctggctggccggcctgttctaccaccacaagttcaactcctccggctgccccgagcgcctggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtggactacccctaccgcctgtggcactacccctgcaccatcaactacaccgtgttcaagatccgcatgtacgtgggcggcgtggagcaccgcctgggcgccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 7 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctggtgggcggccaggccgcccacaccgcctcccgcttcaccggcctgctgacccgcggcgccaagcagaacatccagctgatcaacaccaacggctcctggcacctgaaccgcaccgccctgaactgcaacgactccctgaacaccggctggctggccggcctgttctactaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtggactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 8 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgcctccaccgtgctgatcggccgccaggccgcccgcaccgcctccggcttcaccgccttcctgacccagggcgccaagcagaacatccagctgatcaacaccaacggctcctggcacctgaaccgcaccgccctgaactgcaacgactccctgaacaccggctggctggccggcctgttctaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaacgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 9 - DNA, 1986 bp, Artificial Sequence
  Chemically Synthesized
tacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgcctccaccgtgctgatcggccgccaggccgcccgcaccgcctccggcctgaccgccttcctgacccagggcgccaagcagaacatccagctgatcaacaccaacggctcctggcacctgaaccgcaccgccctgaactgcaacgactccctgaacaccggctggctggccggcctgctgtaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaacgtgtgcggccccgtgtactgcttcaccccctcccccgtggtggtgggcaccaccgaccgcgccggcgcccccacctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 10 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGGQAAYTASSFTALLTPGAKQNIQLINTNGSWHLNRTALNCNDSLNTGWLAGLFYHHKFNSSGCPERMASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVDYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 11 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGGRAAHTASSFTAFFTPGAKQNIQLINTNGSWHLNRTALNCNDSLDTGWLAGLFYHHKFNSSGCPERMASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 12 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGERAAHAASSFTAFLTPGAKQNIQLINTNGSWHLNRTALNCNDSLDTGWLAGLFYHHKFNSSGCPERMASCRPLTDYDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 13 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGERAARAASSFTAFLNPGAKQNIQLINTNGSWHLNRTALNCNDSLDTGWLAGLFYHHKFNSSGCPERMASCRPLTDYDQGWGPISHANGSGPDQRPYCWHYPPRPCGIVPAKTVCGPVYCFTPSPVVVGTTDRAGAPAYNWGENNTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 14 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGDRAARAASSFTAFLNPGAKQNIQLINTNGSWHLNRTALNCNDSLDTGWLAGLFYYHKFNSSGCPERMASCRPLTDYDQGWGPISHANGSGPDQRPYCWHYPPRPCGIVSAKTVCGPVYCFTPSPVVVGTTDRAGAPAYNWGENNTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 15 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDAGTVLIGGEAAYTASSFTALLTPGAKQNIQLINTNGSWHLNRTALNCNDSLNTGWLAGLFYHHKFNSSGCPERLASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVDYPYRLWHYPCTINYTVFKIRMYVGGVEHRLGAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 16 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLVGGQAAHTASRFTGLLTRGAKQNIQLINTNGSWHLNRTALNCNDSLNTGWLAGLFYYHKFNSSGCPERMASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVDYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 17 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDASTVLIGRQAARTASGFTAFLTQGAKQNIQLINTNGSWHLNRTALNCNDSLNTGWLAGLFYHHKFNSSGCPERMASCRPLTDFDQGWGPISHANGSGPDQRPYCWHYPPRPCGIVPAKNVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 18 - protein, 555 aa, Artificial Sequence
  Chemically Synthesized
YQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDASTVLIGRQAARTASGLTAFLTQGAKQNIQLINTNGSWHLNRTALNCNDSLNTGWLAGLLYHHKFNSSGCPERMASCRPLTDFDQGWGPISHANGSGPDQRPYCWHYPPRPCGIVPAKNVCGPVYCFTPSPVVVGTTDRAGAPTYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 19 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcggccaggccgcctacaccgcctcctccttcaccgccctgctgacccccggcgccaagcagaacatccagctgatcaacaccaacggctcctggcacctgaaccgcaccgccctgaactgcaacgactccctgaacaccggctggctggccggcctgttctaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtggactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 20 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcggccgcgccgcccacaccgcctcctccttcaccgccttcttcacccccggcgccaagcagaacatccagctgatcaacaccaacggctcctggcacctgaaccgcaccgccctgaactgcaacgactccctggacaccggctggctggccggcctgttctaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 21 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcgagcgcgccgcccacgccgcctcctccttcaccgccttcctgacccccggcgccaagcagaacatccagctgatcaacaccaacggctcctggcacctgaaccgcaccgccctgaactgcaacgactccctggacaccggctggctggccggcctgttctaccaccacaagttcaactcctccggctgccccgagcgcatggcctcctgccgccccctgaccgactacgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 22 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcgagcgcgccgcccgcgccgcctcctccttcaccgccttcctgaaccccggcgccaagcagaacatccagctgatcaacaccaacggctcctggcacctgaaccgcaccgccctgaactgcaacgactccctggacaccggctggctggccggcctgttctaccaccacaagttcaactcctccggctgccccgagcgcatggcctcctgccgccccctgaccgactacgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacaacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 23 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctgatcggcgaccgcgccgcccgcgccgcctcctccttcaccgccttcctgaaccccggcgccaagcagaacatccagctgatcaacaccaacggctcctggcacctgaaccgcaccgccctgaactgcaacgactccctggacaccggctggctggccggcctgttctactaccacaagttcaactcctccggctgccccgagcgcatggcctcctgccgccccctgaccgactacgaccagggctggggccccatctcccacgccaacggctccggccccgaccagcgcccctactgctggcactaccccccccgcccctgcggcatcgtgtccgccaagaccgtgtgcggccccgtgtactgcttcaccccctcccccgtggtggtgggcaccaccgaccgcgccggcgcccccgcctacaactggggcgagaacaacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 24 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccggcaccgtgctgatcggcggcgaggccgcctacaccgcctcctccttcaccgccctgctgacccccggcgccaagcagaacatccagctgatcaacaccaacggctcctggcacctgaaccgcaccgccctgaactgcaacgactccctgaacaccggctggctggccggcctgttctaccaccacaagttcaactcctccggctgccccgagcgcctggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtggactacccctaccgcctgtggcactacccctgcaccatcaactacaccgtgttcaagatccgcatgtacgtgggcggcgtggagcaccgcctgggcgccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 25 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgccaacaccgtgctggtgggcggccaggccgcccacaccgcctcccgcttcaccggcctgctgacccgcggcgccaagcagaacatccagctgatcaacaccaacggctcctggcacctgaaccgcaccgccctgaactgcaacgactccctgaacaccggctggctggccggcctgttctactaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaccgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtggactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 26 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgcctccaccgtgctgatcggccgccaggccgcccgcaccgcctccggcttcaccgccttcctgacccagggcgccaagcagaacatccagctgatcaacaccaacggctcctggcacctgaaccgcaccgccctgaactgcaacgactccctgaacaccggctggctggccggcctgttctaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaacgtgtgcggccccgtgtactgcttcaccccctcccccgtggtggtgggcaccaccgaccgcgccggcgcccccgcctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 27 - DNA, 2241 bp, Artificial Sequence
  Chemically Synthesized
atgtccaccaaccccaagccccagcgcaagaccaagcgcaacaccaaccgccgcccccaggacgtgaagttccccggcggcggccagatcgtgggcggcgtgtacctgctgccccgccgcggcccccgcctgggcgtgcgcgccacccgcaagacctccgagcggtcccagccccgcggccgccgccagcccatccccaaggcccgccgccccgagggccgcacctgggcccagcccggctacccctggcccctgtacggcaacgagggctgcggctgggccggctggctgctgtccccccgcggctcccgcccctcctggggccccaccgacccccgccgccgctcccgcaacctgggcaaggtgatcgacaccctgacctgcggcttcgccgacctgatgggctacatccccctggtgggcgcccccctgggcggcgccgcccgcgccctggcccacggcgtgcgcgtgctggaggacggcgtgaactacgccaccggcaacctgcccggctgctccttctccatcttcctgctggccctgctgtcctgcctgaccgtgcccgcctccgcctaccaggtgcgcaactccaccggcatctaccacgtgaccaacgactgccccaactcctccatcgtgtacgaggccgacaacgccatcctgcacacccccggctgcgtgccctgcgtgcgcgagggcaacgtgtccaagtgctgggtggccatgacccccaccgtggccacccgcgacggcaagctgcccaccacccagctgcgccgccacatcgacctgctggtgggctccgccaccctgtgctccgccctgtacgtgggcgacctgtgcggctccgtgttcctggtgggccagctgttcaccttctccccccgccgccactggaccacccaggagtgcaactgctccatctaccccggccacatcaccggccaccgcatggcctgggacatgatgatgaactggtcccccaccgccgccctggtggtggcccagctgctgcgcatcccccaggccatcgtggacatgatcgccggcgcccactggggcgtgctggccggcatcgcctacttctccatggtgggcaactgggccaaggtgctggtggtgctgctgctgttcgccggcgtggacgcctccaccgtgctgatcggccgccaggccgcccgcaccgcctccggcctgaccgccttcctgacccagggcgccaagcagaacatccagctgatcaacaccaacggctcctggcacctgaaccgcaccgccctgaactgcaacgactccctgaacaccggctggctggccggcctgctgtaccaccacaagttcaactcctccggctgccccgagcgcatggcctcctgccgccccctgaccgacttcgaccagggctggggccccatctcccacgccaacggctccggccccgaccagcgcccctactgctggcactaccccccccgcccctgcggcatcgtgcccgccaagaacgtgtgcggccccgtgtactgcttcaccccctcccccgtggtggtgggcaccaccgaccgcgccggcgcccccacctacaactggggcgagaacgacaccgacgtgttcgtgctgaacaacacccgcccccccctgggcaactggttcggctgcacctggatgaactccaccggcttcaccaaggcctgcggcgcccccccctgcgccatcggcggcgtgggcaacaagaccctgtactgccccaccgactgcttccgcaagcaccccgaggccacctactcccgctgcggctccggcccctggatcaccccccgctgcctggtgcactacccctaccgcctgtggcactacccctgcaccatcaactacaccgtgttcaagatccgcatgtacgtgggcggcgtggagcaccgcctggaggccgcctgcaactggacccgcggcgagcggtgcgacctggaggaccgcgaccgctccgagctgtcccccctgctgctgtccaccacccagtggcaggtgctgccctgctccttcaccaccctgcccgccctgtccaccggcctgatccacctgcaccagaacatcgtggacgtgcagtacctgtacggcgtgggctcctccatcgcctcctgggccatcaagtgggactacgtggtgctgctgttcctgctgctggccgacgcccgcgtgtgctcctgcctgtggatgatgctgctgatctcccaggtggaggcctaa

SEQ ID NO: 28 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGGQAAYTASSFTALLTPGAKQNIQLINTNGSWHLNRTALNCNDSLNTGWLAGLFYHHKFNSSGCPERMASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVDYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 29 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGGRAAHTASSFTAFFTPGAKQNIQLINTNGSWHLNRTALNCNDSLDTGWLAGLFYHHKFNSSGCPERMASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 30 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGERAAHAASSFTAFLTPGAKQNIQLINTNGSWHLNRTALNCNDSLDTGWLAGLFYHHKFNSSGCPERMASCRPLTDYDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 31 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGERAARAASSFTAFLNPGAKQNIQLINTNGSWHLNRTALNCNDSLDTGWLAGLFYHHKFNSSGCPERMASCRPLTDYDQGWGPISHANGSGPDQRPYCWHYPPRPCGIVPAKTVCGPVYCFTPSPVVVGTTDRAGAPAYNWGENNTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 32 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLIGDRAARAASSFTAFLNPGAKQNIQLINTNGSWHLNRTALNCNDSLDTGWLAGLFYYHKFNSSGCPERMASCRPLTDYDQGWGPISHANGSGPDQRPYCWHYPPRPCGIVSAKTVCGPVYCFTPSPVVVGTTDRAGAPAYNWGENNTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 33 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDAGTVLIGGEAAYTASSFTALLTPGAKQNIQLINTNGSWHLNRTALNCNDSLNTGWLAGLFYHHKFNSSGCPERLASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVDYPYRLWHYPCTINYTVFKIRMYVGGVEHRLGAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 34 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDANTVLVGGQAAHTASRFTGLLTRGAKQNIQLINTNGSWHLNRTALNCNDSLNTGWLAGLFYYHKFNSSGCPERMASCRPLTDFDQGWGPISHANGSGPDQRPYCWHYPPRPCGIVPAKTVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVDYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 35 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDASTVLIGRQAARTASGFTAFLTQGAKQNIQLINTNGSWHLNRTALNCNDSLNTGWLAGLFYHHKFNSSGCPERMASCRPLTDFDQGWGPISHANGSGPDQRPYCWHYPPRPCGIVPAKNVCGPVYCFTPSPVVVGTTDRAGAPAYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 36 - protein, 746 aa, Artificial Sequence
  Chemically Synthesized
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGIYHVTNDCPNSSIVYEADNAILHTPGCVPCVREGNVSKCWVAMTPTVATRDGKLPTTQLRRHIDLLVGSATLCSALYVGDLCGSVFLVGQLFTFSPRRHWTTQECNCSIYPGHITGHRMAWDMMMNWSPTAALVVAQLLRIPQAIVDMIAGAHWGVLAGIAYFSMVGNWAKVLVVLLLFAGVDASTVLIGRQAARTASGLTAFLTQGAKQNIQLINTNGSWHLNRTALNCNDSLNTGWLAGLLYHHKFNSSGCPERMASCRPLTDFDQGWGPISHANGSGPDQRPYCWHYPPRPCGIVPAKNVCGPVYCFTPSPVVVGTTDRAGAPTYNWGENDTDVFVLNNTRPPLGNWFGCTWMNSTGFTKACGAPPCAIGGVGNKTLYCPTDCFRKHPEATYSRCGSGPWITPRCLVHYPYRLWHYPCTINYTVFKIRMYVGGVEHRLEAACNWTRGERCDLEDRDRSELSPLLLSTTQWQVLPCSFTTLPALSTGLIHLHQNIVDVQYLYGVGSSIASWAIKWDYVVLLFLLLADARVCSCLWMMLLISQVEA

SEQ ID NO: 37 - DNA, 1728 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcccacaccgcgtccggttttactgctctccttacacagggcgccaaacagaacatccagctgatcaacactaacggcagttggcacctcaatcgcacggccctgaactgcaatgatagccttaacaccggctggctagcagggcttttctatcaccataaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtggaggcg

SEQ ID NO: 38 - DNA, 1728 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacaggccgcccgcaccgcgtccagttttactactctctttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtggaggcg

SEQ ID NO: 39 - DNA, 1728 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccccaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcggataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcggggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtggccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcagcaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtggaggcg

SEQ ID NO: 40 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctacttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaatggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgaactcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgccgacgcgcgcgtctgctcctgcttgtggatgatgctactcatatcccaagtgga

SEQ ID NO: 41 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggatgacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcctgtggatgatgctactcatatcccaagtgga

SEQ ID NO: 42 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacgccgcgtccagttttactgctctccttacaccgggcgccaatcagaacatccagctgatcaacactaacggcagttggcacctcaatcgcacggccctgaactgcaatgatagccttaacaccggctggctagcagggcttttctatcatcacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgcgaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 43 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 44 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgccgctgctatttgccggcgttgacgcgggtaccgtcctcatcggaggagaggccgcctacgccgcgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 45 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttgctgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 46 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgattgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtatttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 47 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgtagacgcgggtaccgtcctcatcggaggagaggccgcctacgccgcgtccagttttactgctctccttacaccgggcgcccaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 48 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacgccgcgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 49 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttatatcgggcgccaaacagaacatccggctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 50 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccacgtccagttttactgctctccttacaccgggcgccaaccagaacatccagctgatcaacactaacggcagctggcacctcaatcgcacggccctgaactgcaatgatagccttaacaccggctggctagcagggcttttctatcgccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccgtcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 51 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgccaacaccgcgtccagttttactgctctccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 52 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggaccacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 53 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcccacaccgcgtccagtttgactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 54 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacaccgggcgccagacagaacatccagctgatcaacactaacggcagttggcacctcaatcgcacggccctgaactgcaatgatagccttaacaccggctggctagcagggctattctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 55 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccacgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttttgcttgcagacgcgcgcgtctgctcctgcttgtggatgatgctactcatatcccaagtgga

SEQ ID NO: 56 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcccacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 57 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcagcactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgtctggtcgactatccatataggctttggtattatccttgcaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 58 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatactgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 59 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccgctggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcctctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 60 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgccaacaccgcgtccagttttactgctctccttacacggggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccctattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 61 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggatggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 62 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaataccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 63 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgtcctcttgtttcttctgcttgcagacgcgcgcgtctgctcctgcttgtggatgatgctactcatatcccaagtgga

SEQ ID NO: 64 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttaccgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 65 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaataatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggctttgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 66 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 67 - DNA, 1724 bp, Artificial Sequence
  Chemically Synthesized
ggttgctctttctccatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagtcttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 68 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccacgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttctttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 69 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcaggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgcgctatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 70 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccagacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcattaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 71 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacgccgcgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaattggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 72 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccacataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggatggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagctcgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgacgctactcatatcccaagtgga

SEQ ID NO: 73 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggtttcactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggatggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 74 - DNA, 1724 bp, Artificial Sequence
  Chemically Synthesized
ggttgctctttctctatcttccttctagccctgctttcttgcctgactgtacccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagctccgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctctttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaattggacgcggggcgagcgttgcgatctggatgacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 75 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctctttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaagatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccccgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 76 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcatagagacctcatcgggggacaagccgcccacgccgcgtacagttttagtgctctctttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 77 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgagcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 78 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcccacaccgcgtccggttttactgctctccttacacagggcgccaaacagaacatccagctgatcaacactaacggcagttggcacctcaatcgcacggccctgaactgcaatgatagccttaacaccggttggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 79 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcccacaccgcgtccggttttactgctctccttacacagggcgccaaacagaacatccagctgatcaacactaacggcagttggcacctcaatcgcacggccctgaactgcaatgatagccttaacaccggctggctagcagggcttttctatcaccataaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 80 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgctggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctcctttcatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 81 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccacgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctgctcatatcccaagtgga

SEQ ID NO: 82 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaagatcaggatgtatgtgggaggggtcgagcacaggctaggagccgcctgtaactggacgcggggcgagcgttgcgatctggaagacagggacaggtccgagctcagcccgttgttgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 83 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtggggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataatgacctcatcgggggacaagccgcccacgccgcgtacagttttagtgctctctttacatcgggcgccaaacagaacatccagctgatcaacactaacggcagttggcacctcaatcgcacggccctgaactgcaatgatagccttaacaccggttggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 84 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacgccgcgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccggccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 85 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcccacaccgcgtccggttttactgctctccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 86 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccggttttactgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggttgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 87 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggcctccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacgccgcgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaaggccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaataagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 88 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 89 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 90 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcrtatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 91 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgtttgcagacgcgcgcgtctgctcctgcttgtggatgatgctactcatatcccaagtgga

SEQ ID NO: 92 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacgccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 93 - DNA, 1724 bp, Artificial Sequence
  Chemically Synthesized
ggttgctctttctctatcttccttctagccctgctttcgtgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttagcaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 94 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggatgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 95 - DNA, 1724 bp, Artificial Sequence; identical to SEQ ID NO: 88
  Chemically Synthesized

SEQ ID NO: 96 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatctatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 97 - DNA, 1724 bp, Artificial Sequence
  Chemically Synthesized
ggttgctctttctctatcttccttctagccctgctttcttgtctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtatcgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgacgaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 98 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacgcccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 99 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccccgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 100 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcatcatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 101 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcgttatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 102 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccctaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 103 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggataaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 104 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggtccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggccgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 105 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtggaaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 106 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggtgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 107 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgcacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 108 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccccaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcggataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcggggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtggccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcagcaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 109 - DNA, 1724 bp, Artificial Sequence
  Chemically Synthesized
ggttgctctttctctatcttccttctagccctgctttcttgcctgactgtgtccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacgggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 110 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaaaaccgtcctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 111 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccacgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 112 - DNA, 1724 bp, Artificial Sequence
  Chemically Synthesized
  misc_feature (551)..(551): n is a, c, g, or t
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgtatggcatgggatatgatgatgaactggtcccctacggcggcgttggtagtagctcagctgctccggatcccacaagccatcgtggacatgatcgctggtgcccactgggnagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 113 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtgccgtcctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 114 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggatggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgccaacaccgcgtccggttttgctgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgggaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 115 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgcataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcggagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 116 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttccatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 117 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgccaacaccgcgtccagttttactgctctctttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 118 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcatggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcctacgccgcgtccagttttactgctttccttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 119 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcaccggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaaggccttgtggcattgtgtccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 120 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcggataccgtcctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 121 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccagacttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 122 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccccaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacgccgcgtccaggtttactggtctccttacacggggcgccaaacagaacatccagctgatcaacactaacggcagttggcacctcaatcgcacggccctgagctgcaatgatagccttaacaccggctggctagcggggcttttctattaccacaaattcaactcttcgggctgtcccgaaaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 123 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccgcaccgcgtccagttttactggtctccttacacggggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacatcgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctacttatatcccaagtgga

SEQ ID NO: 124 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccccaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcggggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 125 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagtgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgccaacaccgcgtccggttttgctgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccaccggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 126 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcgggagacaggccgcccacgccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttgtactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcctgtggatgatgctactcatatcccaagtgga

SEQ ID NO: 127 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 128 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgggaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcttgggctattaagtgggattacgtcgttctcttgtttcttctgcttgcagacgcgcgcgtctgctcctgcttgtggatgatgctactcatatcccaagtgga

SEQ ID NO: 129 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgccaacaccgcgtccggttttgctgctctccttacatcgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcatcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 130 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcctacgccgcgtccagttttactgctttccttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 131 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacgggccgcctacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 132 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccccaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggaccggccgcccacaccgcgtccaggtttactggtctccttacacggggcgccaaacagaacatccagctgatcaacactaacggcagttggcacctcaatcgcacggccctgaactgcaatgatagccttaacaccggctggctagcggggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 133 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 134 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 135 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtaggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 136 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacaggccgcccgcaccgcgtccagttttactactctctttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 137 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggcttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 138 - DNA, 1724 bp, Artificial Sequence
  Chemically Synthesized
ggttgctctttctctatctttcttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaakaccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagtcagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggctgatgctactcatatcccaagtgga

SEQ ID NO: 139 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccgcaccgcgtccagttttactggtctccttacacggggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctacttatatcccaagtgga

SEQ ID NO: 140 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgacctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 141 - DNA, 1724 bp, Artificial Sequence
  Chemically Synthesized
ggttgctctttctctatctttcttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccggcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 142 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcatcgcatggcatgggatatgatgatgaactggtcccctacggcggcgttggtagtagctcagctgctccggatcccacaagccatcgtggacatggtcgctggtgcccactggggagtcctggcgggcatagcgtacttctccatggtggggaattgggcgaaggtcctggtggtgctgctgctatttgccggcgttgacgcgaataccgtcctcatcggaagacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaagatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 143 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccatcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 144 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaggacgggccgcccacaccgcgtccagttttactgctttctttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcgccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 145 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgtccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 146 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccggccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccggcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 147 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaaaccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccgcaccgcgtccagttttactggtctccttacacggggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataagctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctacttatatcccaagtgga

SEQ ID NO: 148 - DNA, 1724 bp, Artificial Sequence
  Chemically Synthesized
ggttgctctttctctatctttcttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtaagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 149 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccacgccgcgtccagttttactgctttccttacaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 150 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccccaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgaccgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 151 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaagacaggccgcccacaccgcgtccagacttactggtctccttacacsgggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 152 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccccaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtacgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 153 - DNA, 1724 bp, Artificial Sequence
  Chemically Synthesized
ggttgctctttctctatctttcttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcgtcggaggacaggccgcccacaccgcgtccaggtttactggtctccttacacggggcgccaaacagaacatccagctgatcaacactaacggcagttggcacctcaatcgcacggccctgaactgcaatgatagccttaacaccggctggctagcagggcttttctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgggaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 154 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagtttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcgggagacaggccgcccacaccgcgtccagttttactactctctttacaccgggcgccaaacagaacatccagctgatcaacactaacggcagttggcacctcaatcgtacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 155 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 156 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacctccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 157 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccacgccgcgtccaggtttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaatgccacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 158 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcggataccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactctacgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 159 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 160 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcactacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacctaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 161 - DNA, 1724 bp, Artificial Sequence
  Chemically Synthesized
ggttgctctttctctatcttccttctagccctgctttcttgcctgactgtgcccgcttcggcctaccaggtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggatagcagggcttttctatcaccacaaattcaactcttcgggctgtcccgagaggatggccagctgccggcccctcaccgattatgaccagggctggggccctatcagtcatgccaatggaagtggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggataggtccgagctcagcccgttgctgctgtccaccacacagtggcaggtccttccctgttccttcacgaccttgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 162 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttccttgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 163 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcactacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcacaaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 164 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 165 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaattggggtgagaatgacacggacgtcttcgtccttaataacaccaggccaccgctgggcaattggttcggttgtatctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccgtcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctacttgcagacgcgcgcgtctgctcctgcttgtggatgatgctactcatatcccaagtgga

SEQ ID NO: 166 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaattggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccgtcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 167 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctaccccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaaggcaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaattggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccgtcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 168 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtatcgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 169 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgattgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 170 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 171 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacgtgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 172 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaattcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccactacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 173 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtccgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttcacaccggctggctagcagggcttttctatcaccacaaattcaactcttcgggctgccccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtatttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 174 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgtgggtctgtcttccttgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 175 - DNA, 1724 bp, Artificial Sequence
  Chemically Synthesized
ggttgctctttctctatcttccttctagccctgctttcttgcctgactgtgcccgcttcggcctaccaggtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 176 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagccatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 177 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctcacccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaattggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccgtcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 178 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaactgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcgtccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 179 - DNA, 1724 bp, Artificial Sequence
  Chemically Synthesized
ggttgctctttctctatcttccttctagccctgctttcttgcctgactgtgcccgcttcggcctaccaggtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaactctaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 180 - DNA, 1724 bp, Artificial Sequence; identical to SEQ ID NO: 155
  Chemically Synthesized

SEQ ID NO: 181 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcactacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 182 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttccttgttggtcaactgttcaccttctctcccaggcgccactggacgacgcaagaatgcaattgttctatctatcccggccatataacgggtcaccgcatggcatgggatatgatgatgaactggtcccctacggcggcgttggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 183 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcgccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaaccaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 184 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 185 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 186 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtggccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 187 - DNA, 1724 bp, Artificial Sequence
  Chemically Synthesized
ggttgctctttctctatcttccttctagccctgctttcctgcctgactgtgcccgcttcggcctaccaggtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacgtccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 188 - DNA, 1724 bp, Artificial Sequence
  Chemically Synthesized
ggttgccctttctctatcttccttctagccctgctttcttgcctgactgtgcccgcttcggcctaccaagtccgcaactccacggggatataccatgtcaccaatgattgccctaattcgaatattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacctccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 189 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccaccttcaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 190 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgctggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 191 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgttcaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 192 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggcagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttgcaccgggcgccaaacagaacatccagctgatcaacactaacggcagttggcacctcaatcgcacggccctgaactgcaatgatagccttgacaccggctggctagcagggcttttctatcactacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgtcacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttctcctgcttgcagacgcgcgcgtctgctcctgcttgtggatgatgctactcatatcccaagtgga

SEQ ID NO: 193 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggcgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 194 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggttttactgctttccttacacagggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgcctgcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 195 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctatgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 196 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 197 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgactgacagggcgggcgcgccaacctacaactggggtgagaatgacacggacgtcctcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 198 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccatctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 199 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccggtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaataccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgacctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 200 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggtcttactgctttccttacacagggcgccaaacagaacatccagctgatcaacactaacggcagttggcacctcaatcgcacggccctgaactgcaatgatagcctcaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 201 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcattggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 202 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgtcggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccggtatattgcttcactcccagccccgtggtggtgggaacgaccgacagggcgggcgtgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaataccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgacctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 203 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccgccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 204 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 205 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcctcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 206 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatcctcgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 207 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 208 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccggccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 209 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcctcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccaccaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 210 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaaaccaggccgcccgcaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaggccacgtactctcggtgcggctccggtccgtggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 211 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgtygcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 212 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggttctggtggtgctgctgctatttgccggcgttgacgcgaataccgtcctcatcggaagacaggccgcccacaccgcgtccggtcttactgctttccttacacagggcgccaaacagaacatccagctgatcaacactaacggcagttggcacctcaaccgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccggtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaataccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgacctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 213 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttccccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaagacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccggtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaataccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgacctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgttactcatatcccaagtgga

SEQ ID NO: 214 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccggccgcaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 215 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataataccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 216 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaacgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctatcaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 217 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggctatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacagctggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 218 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgtaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 219 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacaggccgcccgcaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 220 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcccacaccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccggtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaataccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgacctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 221 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggtgggcatagcgtacttctccatggtggggaattgggcgaaggtcctggtggtgctgctgctatttgccggcgttgacgcgagtaccgtcctcatcggaagacaggccgcccgcgccgcgtccggtcttactgctttccttacacagggcgccaaacagaacatccagctgatcaacactaacggcagttggcacctcaatcgcacggccctgaactgcaatgatagccttaacaccggctggctagcagggcttctctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 222 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcagacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgagtaccgtcctcatcggaagacagaccgcccgcaccgcgtccggtcttactgctttccttacacagggcgccaaacagaacatccagctgatcaacactaacggcagttggcacctcaatcgcacggccctgaactgcaatgatagccttaacaccggctggctagcagggcttctctattaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaacgtgtgtggcccagtatattgcttcactcccagccccgtggtggtgggaacgaccgacagggcgggcgcgccaacctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 223 - DNA, 1724 bp, Artificial Sequence
  Chemically Synthesized
ggttgctctttctctatcttccttctagccctgctttcttgcctgactgtgcccgcttcggcctaccaagttcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 224 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggttccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 225 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacactaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 226 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtaatagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 227 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaaaaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 228 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 229 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggataggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 230 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtatcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 231 - DNA, 1724 bp, Artificial Sequence
  Chemically Synthesized
ggttgctctttctctatcttccttctagccctgctttcttgcctgactgtgcccgcttcggcctaccaagtccgcaactccacggggatatatcatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggagaccgggccgcccgcgccgcgtccagttttactgctttccttaacccgggcgccaaacagaacatccagctgatcaacactaacggcagttggcacctcaatcgcacggccctgaactgcaatgatagccttgacaccggctggctagcagggcttttctattaccacaaattcaactcttcgggctgtcccgagaggatggccagctgccggcccctcaccgattatgaccagggctggggccctatcagtcatgccaatggaagcggccccgaccaacgcccttactgctggcactaccctccaagaccttgtggcattgtgtccgcgaagaccgtgtgtggcccagtatattgcttcactcccagccccgtggtggtgggaacgaccgacagggcgggcgcgccagcctacaactggggtgagaataacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtccactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcggacgcgcgcgtctgctcctgcttgtggatgatgctactcatatcccaagtgga

SEQ ID NO: 232 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgctgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 233 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagtcttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 234 - DNA, 1724 bp, Artificial Sequence
  Chemically Synthesized
ggttgctctttctctatcttccttctagccctgctttcttgcctgactgtgcccgcttcggcctaccaagtgcgtaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgttttcgtccttaacaacaccaggccaccgctgggcaattggttcggttgtacctggatgaactcaaccggattcaccaaagcgtgcggagcgcccccttgtgccatcggaggggtgagcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 235 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtactgtcctcatcggaggagaggccgcctacaccgcgtccagttttactgctctctttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 236 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccgagtgga

SEQ ID NO: 237 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaacgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 238 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcctttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 239 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagtgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 240 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcacccccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 241 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgcttcggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 242 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctacttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 243 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaccagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggccggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 244 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacattcagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 245 - DNA, 1724 bp, Artificial Sequence
  Chemically Synthesized
ggttgctctttttctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgactctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 246 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacaggacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 247 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccgtggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 248 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaatgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcatcatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 249 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtacagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 250 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagcttagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 251 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggccgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 252 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccagacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 253 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 254 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcatcgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 255 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccgggagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 256 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctgtttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 257 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcaagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 258 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccgacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcargtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 259 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgttttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgacgctactcatatcccaagtgga

SEQ ID NO: 260 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatggttgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctcttcttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 261 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgacctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 262 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgttaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgctcgtcgggagcgccaccctctgctcggccctctacgtgggggacctgtgcgggtctgtctttctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtgggaaattgggcgaaggtcctggtggtgctgctgctatttgccggcgttgacgcgcataaagacctcatcgggggacaagccgcccacgccgcgtacagttttagtgctctctttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactacccatacaggctttggcattatccttgtaccatcaactataccatattcaaaatcaggatgtatgtgggaggggtcgagcacaggctggaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 263 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacactgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgcgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 264 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggwtggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 265 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctggtccttcacgaccctgccagccttgtccaccggcctcatccacctccaccagaacattgtggacgtgcagtacttgtacggtgtggggtcgagcatcgcgtcctgggctattaagtgggattacgtcgttctcttgtttcttctgcttgcagacgcgcgcgtctgctcctgcttgtggatgatgctactcatatcccaagtgga

SEQ ID NO: 266 - DNA, 1724 bp, Artificial Sequence
  Chemically Synthesized
ggttgctctttctctatcttccttctagccctgctttcttgcctgactgtgcccgcttcggcctaccaagtccgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgaataccgtcctcatcggaggacaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggatggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaataacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcacctataccgtattcaaaatcaggatgtatgtgggaggggtcgagcacaggctagaagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 267 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggccaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgggctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

SEQ ID NO: 268 - DNA, 1724 bp, Artificial Sequence
  Chemically Synthesized
ggttgctctttctctatcttccttctagccctgctttcttgcctgactgtgcccgcttcggcctaccaagtgcgcaactccacggggatataccatgtcaccaatgattgccctaattcgagtattgtgtacgaggcggacaatgccatcctgcatactccgggatgtgtcccttgcgttcgcgagggtaacgtctcgaagtgctgggtggcgatgacccccacggtggtcaccagggacggcaaactccctacaacgcagcttcgacggcatatcgatctgcttgtcgggagcgccaccctctgctcggccctctacgtgggggacctgtgcgggtctgtcttcctcgttggtcaactgttcaccttctctcccaggcgccactggacgacgcaagaatgcaattgttctatctatcccggccatataacgggtcaccgcatggcatgggatatgatgatgaactggtcccctacggcggcgttggtagtagctcagctgctccggatcccacaagccatcgtggacatgatcgctggtgcccactggggagtcctggcgggcatagcgtacttctccatggtggggaattgggcgaaggtcctggtggtgctgctgctatttgccggcgttgacgcgggtaccgtcctcatcggaggagaggccgcctacaccgcgtccagttttactgctctccttacaccgggcgccaaacagaacatccagctgatcaacactaacggcagttggcacctcaatcgcacggccctgaactgcaatgatagccttaacaccggctggctagcagggcttttctatcaccacaaattcaactcttcgggctgtcccgagaggttggccagctgccggcccctcaccgattttgaccagggctggggccctatcagtcatgccaatggaagcggccccgaccaacgcccttactgctggcactaccctccaagaccttgtggcattgtgcccgcgaagaccgtgtgtggcccagtatattgcttcactcccagccccgtggtggtgggaacgaccgacagggcgggcgcgccagcctacaactggggtgagaatgacacggacgtcttcgtccttaacaacaccaggccaccgctgggcaattggttcggttgtacctggatgaactcaaccggattcaccaaagcgtgcggagcgcccccttgtgccatcggaggggtgggcaacaagaccttatactgccccactgactgtttccgcaagcatccggaagccacgtactctcggtgcggctccggtccatggatcacacccaggtgcctggtcgactatccatataggctttggcattatccttgtaccatcaactataccgtattcaaaatcaggatgtatgtgggaggggtcgagcacaggctaggagccgcctgtaactggacgcggggcgagcgttgcgatctggaagacagggacaggtccgagctcagcccgttgctgctgtccaccacacagtggcaggtccttccctgttccttcacgaccctgccagccttgtccaccggcctcatccacctccaccagaacattgtggacgtgcagtacttgtacggtgtggggtcaagcatcgcgtcctgggctattaagtgggattacgtcgttctcttgtttcttctgcttgcagacgcgcgcgtctgctcctgcttgtggatgatgctactcatatcccaagtgga

What is claimed is:

1. A lineage vaccine comprising a combination of isolated nucleoside-modified RNA molecules, wherein the combination of isolated nucleoside-modified RNA molecules encodes a combination of sequential lineage antigens for inducing an immune response against Hepatitis C virus (HCV) in a subject, wherein the combination of isolated nucleoside-modified RNA molecules comprises at least one isolated nucleoside-modified RNA molecule encoding each of the HCV antigens as set forth in SEQ ID NO:28, SEQ ID NO:29, SEQ ID NO:30, SEQ ID NO:31, SEQ ID NO:32, SEQ ID NO:33, SEQ. ID NO:34, SEQ ID NO:35 and SEQ ID NO:36.

2. The lineage vaccine of claim 1, wherein the at least one isolated nucleoside-modified RNA comprises a nucleoside selected from the group consisting of pseudouridine and 1-methyl-pseudouridine.

3. The lineage vaccine of claim 1, wherein the at least one isolated nucleoside-modified RNA is a purified nucleoside-modified RNA.

4. The lineage vaccine of claim 1, wherein the combination of nucleoside-modified RNA molecules comprises RNA sequences encoded by DNA sequences comprising: SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, and SEQ ID NO: 27.

5. The lineage vaccine of claim 1, comprising a combination of lipid nanoparticles (LNPs) encapsulating the isolated RNA molecules.

6. The lineage vaccine of claim 1, wherein the at least one nucleoside-modified RNA further encodes at least one adjuvant.

7. The lineage vaccine of claim 5, wherein each nucleoside-modified RNA is encapsulated within a different LNP.

8. The lineage vaccine of claim 1, wherein the composition is a vaccine.

* * * * *

UNITED STATES PATENT AND TRADEMARK OFFICE
CERTIFICATE OF CORRECTION

| | | |
|---|---|---|
| PATENT NO. | : 11,660,332 B2 | Page 1 of 1 |
| APPLICATION NO. | : 16/608392 | |
| DATED | : May 30, 2023 | |
| INVENTOR(S) | : Drew Weissman et al. | |

It is certified that error appears in the above-identified patent and that said Letters Patent is hereby corrected as shown below:

In the Specification

Column 1, Lines 19-24 should read as follows:
--STATEMENT REGARDING FEDERALLY SPONSORED RESEARCH OR DEVELOPMENT
This invention was made with government support under AI088791, AI102761, AI094189, AI050484, and AI084860 awarded by the National Institutes of Health. The government has certain rights in the invention.--

Signed and Sealed this
Thirty-first Day of October, 2023

*Katherine Kelly Vidal*

Katherine Kelly Vidal
*Director of the United States Patent and Trademark Office*